United States Patent
Bancel et al.

(10) Patent No.: US 9,464,124 B2
(45) Date of Patent: Oct. 11, 2016

(54) ENGINEERED NUCLEIC ACIDS AND METHODS OF USE THEREOF

(71) Applicant: Moderna Therapeutics, Inc., Cambridge, MA (US)

(72) Inventors: Stephane Bancel, Cambridge, MA (US); Jason P. Schrum, Philadelphia, PA (US); Alexander Aristarkhov, Chestnut Hill, MA (US)

(73) Assignee: Moderna Therapeutics, Inc., Cambridge, MA (US)

( * ) Notice: Subject to any disclaimer, the term of this patent is extended or adjusted under 35 U.S.C. 154(b) by 0 days.

(21) Appl. No.: 14/533,264

(22) Filed: Nov. 5, 2014

(65) Prior Publication Data

US 2015/0056253 A1 Feb. 26, 2015

Related U.S. Application Data

(63) Continuation of application No. 14/342,905, filed as application No. PCT/US2012/054561 on Sep. 11, 2012, now abandoned.

(60) Provisional application No. 61/533,537, filed on Sep. 12, 2011.

(51) Int. Cl.
| | |
|---|---|
| *C07H 21/02* | (2006.01) |
| *C07H 21/04* | (2006.01) |
| *C07H 21/00* | (2006.01) |
| *C07K 14/47* | (2006.01) |
| *A61K 45/06* | (2006.01) |
| *A61K 38/17* | (2006.01) |
| *A61K 38/46* | (2006.01) |

(52) U.S. Cl.
CPC ....... *C07K 14/4723* (2013.01); *A61K 38/1729* (2013.01); *A61K 38/465* (2013.01); *A61K 45/06* (2013.01); *C12Y 301/27* (2013.01)

(58) Field of Classification Search
CPC ............ A61K 38/1729; A61K 47/00; A61K 47/48815; A61K 48/00
See application file for complete search history.

(56) References Cited

U.S. PATENT DOCUMENTS

| | | | |
|---|---|---|---|
| 2,008,526 A | 7/1935 | Wrappler et al. |
| 3,552,394 A | 1/1971 | Horn et al. |
| 3,737,524 A | 6/1973 | Ebel et al. |
| 3,766,907 A | 10/1973 | Muenzer |
| 3,906,092 A | 9/1975 | Hilleman et al. |
| 4,373,071 A | 2/1983 | Itakura |
| 4,399,216 A | 8/1983 | Axel et al. |
| 4,401,796 A | 8/1983 | Itakura |
| 4,411,657 A | 10/1983 | Galindo |
| 4,415,732 A | 11/1983 | Caruthers et al. |
| 4,458,066 A | 7/1984 | Caruthers et al. |
| 4,474,569 A | 10/1984 | Newkirk |
| 4,500,707 A | 2/1985 | Caruthers et al. |
| 4,579,849 A | 4/1986 | MacCoss et al. |
| 4,588,585 A | 5/1986 | Mark et al. |
| 4,668,777 A | 5/1987 | Caruthers et al. |
| 4,737,462 A | 4/1988 | Mark et al. |
| 4,816,567 A | 3/1989 | Cabilly et al. |
| 4,879,111 A | 11/1989 | Chong |
| 4,957,735 A | 9/1990 | Huang |
| 4,959,314 A | 9/1990 | Mark et al. |
| 4,973,679 A | 11/1990 | Caruthers et al. |
| 5,012,818 A | 5/1991 | Joishy |
| 5,017,691 A | 5/1991 | Lee et al. |
| 5,021,335 A | 6/1991 | Tecott et al. |
| 5,036,006 A | 7/1991 | Sanford et al. |
| 5,047,524 A | 9/1991 | Andrus et al. |
| 5,116,943 A | 5/1992 | Koths et al. |
| 5,130,238 A | 7/1992 | Malek et al. |
| 5,132,418 A | 7/1992 | Caruthers et al. |
| 5,153,319 A | 10/1992 | Caruthers et al. |
| 5,168,038 A | 12/1992 | Tecott et al. |
| 5,169,766 A | 12/1992 | Schuster et al. |
| 5,194,370 A | 3/1993 | Berninger et al. |
| 5,199,441 A | 4/1993 | Hogle |
| 5,240,855 A | 8/1993 | Tomes |
| 5,240,885 A | 8/1993 | Aitken et al. |
| 5,262,530 A | 11/1993 | Andrus et al. |
| 5,273,525 A | 12/1993 | Hofman |
| 5,298,422 A | 3/1994 | Schwartz et al. |
| 5,332,671 A | 7/1994 | Ferrara et al. |
| 5,399,491 A | 3/1995 | Kacian et al. |
| 5,409,818 A | 4/1995 | Davey et al. |

(Continued)

FOREIGN PATENT DOCUMENTS

| | | |
|---|---|---|
| CA | 2376634 | 12/2000 |
| CA | 2473135 | 6/2003 |

(Continued)

OTHER PUBLICATIONS

Kariko, K., et al. Molecular Therapy, vol. 16, No. 11, pp. 1833-1840, Nov. 2008.*
Egeter, O. et al., Eradication of disseminated lymphomas with CpG-DNA activated T helper type 1 cells from nontransgenic mice. Cancer Res. Mar. 15, 2000;60(6):1515-20.
El Ouahabi, A., et al., Double long-chain amidine liposome-mediated self replicating RNA transfection. FEBS Letters. Feb. 1996; 380(1-2): 108-112.
Elango, N., et al., Optimized transfection of mRNA transcribed from a d(A/T)100 tail-containing vector. Biochem Biophys Res Commun. 2005; 330: 958-966.
El Bashir, S.M. et al. Duplexes of 21 nucleotide RNAs mediate RNA interference in cultured mammalian cells. Nature. May 24, 2001;411(6836):494-8.

(Continued)

*Primary Examiner* — Rodney P Swartz
(74) *Attorney, Agent, or Firm* — Wolf, Greenfield & Sacks, P.C.

(57) ABSTRACT

Provided are compositions and methods for delivering biological moieties such as modified nucleic acids into cells to kill or reduce the growth of microorganisms. Such compositions and methods include the use of modified messenger RNAs, and are useful to treat or prevent microbial infection, or to improve a subject's heath or wellbeing.

17 Claims, No Drawings

(56) References Cited

U.S. PATENT DOCUMENTS

| | | |
|---|---|---|
| 5,426,180 A | 6/1995 | Kool |
| 5,437,990 A | 8/1995 | Burg et al. |
| 5,457,041 A | 10/1995 | Ginaven et al. |
| 5,466,586 A | 11/1995 | Davey et al. |
| 5,484,401 A | 1/1996 | Rodriguez et al. |
| 5,514,545 A | 5/1996 | Eberwine |
| 5,527,288 A | 6/1996 | Gross et al. |
| 5,545,522 A | 8/1996 | Van Gelder et al. |
| 5,554,517 A | 9/1996 | Davey et al. |
| 5,580,859 A | 12/1996 | Felgner et al. |
| 5,588,960 A | 12/1996 | Edwards et al. |
| 5,589,466 A | 12/1996 | Felgner et al. |
| 5,663,153 A | 9/1997 | Hutherson et al. |
| 5,665,545 A | 9/1997 | Malek et al. |
| 5,672,491 A | 9/1997 | Khosla et al. |
| 5,674,267 A | 10/1997 | Mir et al. |
| 5,677,124 A | 10/1997 | DuBois et al. |
| 5,679,512 A | 10/1997 | Laney et al. |
| 5,693,622 A | 12/1997 | Wolff et al. |
| 5,693,761 A | 12/1997 | Queen et al. |
| 5,697,901 A | 12/1997 | Ericksson |
| 5,700,642 A | 12/1997 | Monforte et al. |
| 5,702,384 A | 12/1997 | Umeyama et al. |
| 5,703,055 A | 12/1997 | Felgner et al. |
| 5,712,127 A | 1/1998 | Malek et al. |
| 5,716,785 A | 2/1998 | Van Gelder et al. |
| 5,736,137 A | 4/1998 | Anderson et al. |
| 5,756,264 A | 5/1998 | Schwartz et al. |
| 5,759,179 A | 6/1998 | Balbierz |
| 5,766,903 A | 6/1998 | Sarnow et al. |
| 5,773,244 A | 6/1998 | Ares, Jr. et al. |
| 5,776,456 A | 7/1998 | Anderson et al. |
| 5,789,554 A | 8/1998 | Leung et al. |
| 5,807,707 A | 9/1998 | Andrews et al. |
| 5,824,307 A | 10/1998 | Johnson |
| 5,824,497 A | 10/1998 | Andrews et al. |
| 5,840,299 A | 11/1998 | Bendig et al. |
| 5,843,439 A | 12/1998 | Anderson et al. |
| 5,848,996 A | 12/1998 | Eldor |
| 5,849,546 A | 12/1998 | Sousa et al. |
| 5,851,829 A | 12/1998 | Marasco et al. |
| 5,861,501 A | 1/1999 | Benseler et al. |
| 5,869,230 A | 2/1999 | Sukhatme |
| 5,889,136 A | 3/1999 | Scaringe et al. |
| 5,891,636 A | 4/1999 | Van Gelder et al. |
| 5,914,269 A | 6/1999 | Bennett et al. |
| 5,955,310 A | 9/1999 | Widner et al. |
| 5,958,688 A | 9/1999 | Eberwine et al. |
| 5,962,271 A | 10/1999 | Chenchik et al. |
| 5,962,272 A | 10/1999 | Chenchik et al. |
| 5,965,720 A | 10/1999 | Gryaznov et al. |
| 5,965,726 A | 10/1999 | Pavlakis et al. |
| 5,980,887 A | 11/1999 | Isner et al. |
| 5,989,911 A | 11/1999 | Fournier et al. |
| 5,994,511 A | 11/1999 | Lowman et al. |
| 6,004,573 A | 12/1999 | Rathi et al. |
| 6,019,747 A | 2/2000 | McPhee |
| 6,022,715 A | 2/2000 | Merenkova et al. |
| 6,057,494 A | 5/2000 | Koops et al. |
| 6,063,603 A | 5/2000 | Davey et al. |
| 6,074,642 A | 6/2000 | Wang et al. |
| 6,090,382 A | 7/2000 | Salfeld et al. |
| 6,090,591 A | 7/2000 | Burg et al. |
| 6,096,503 A | 8/2000 | Sutcliffe et al. |
| 6,100,024 A | 8/2000 | Hudson et al. |
| 6,124,091 A | 9/2000 | Petryshyn |
| 6,132,419 A | 10/2000 | Hofmann |
| 6,147,055 A | 11/2000 | Hobart et al. |
| 6,177,274 B1 | 1/2001 | Park et al. |
| 6,187,287 B1 | 2/2001 | Leung et al. |
| 6,190,315 B1 | 2/2001 | Kost et al. |
| 6,210,931 B1 | 4/2001 | Feldstein et al. |
| 6,214,804 B1 | 4/2001 | Felgner et al. |
| 6,217,912 B1 | 4/2001 | Park et al. |
| 6,228,640 B1 | 5/2001 | Cezayirli et al. |
| 6,234,990 B1 | 5/2001 | Rowe et al. |
| 6,235,883 B1 | 5/2001 | Jakobovits et al. |
| 6,239,116 B1 | 5/2001 | Krieg et al. |
| 6,251,665 B1 | 6/2001 | Cezayirli et al. |
| 6,255,076 B1 | 7/2001 | Widner et al. |
| 6,258,558 B1 | 7/2001 | Szostak et al. |
| 6,261,584 B1 | 7/2001 | Peery et al. |
| 6,265,387 B1 | 7/2001 | Wolff et al. |
| 6,265,389 B1 | 7/2001 | Burke |
| 6,267,987 B1 | 7/2001 | Park et al. |
| 6,291,170 B1 | 9/2001 | Van Gelder et al. |
| 6,300,484 B1 | 10/2001 | Duhl |
| 6,303,378 B1 | 10/2001 | Bridenbaugh et al. |
| 6,303,573 B1 | 10/2001 | Ruoslahti et al. |
| 6,322,967 B1 | 11/2001 | Parkin |
| 6,326,174 B1 | 12/2001 | Joyce et al. |
| 6,334,856 B1 | 1/2002 | Allen et al. |
| 6,355,245 B1 | 3/2002 | Evans et al. |
| 6,368,801 B1 | 4/2002 | Faruqi |
| 6,376,248 B1 | 4/2002 | Hawley-Nelson et al. |
| 6,395,253 B2 | 5/2002 | Levy et al. |
| 6,399,061 B1 | 6/2002 | Anderson et al. |
| 6,406,705 B1 | 6/2002 | Davis et al. |
| 6,410,276 B1 | 6/2002 | Burg et al. |
| 6,413,942 B1 | 7/2002 | Felgner et al. |
| 6,433,155 B1 | 8/2002 | Umansky et al. |
| 6,440,096 B1 | 8/2002 | Lastovich et al. |
| 6,455,043 B1 | 9/2002 | Grillo-Lopez |
| 6,491,657 B2 | 12/2002 | Rowe et al. |
| 6,500,419 B1 | 12/2002 | Hone et al. |
| 6,500,919 B1 | 12/2002 | Adema et al. |
| 6,514,498 B1 | 2/2003 | Antonsson et al. |
| 6,514,948 B1 | 2/2003 | Raz et al. |
| 6,517,869 B1 | 2/2003 | Park et al. |
| 6,520,949 B2 | 2/2003 | St. Germain |
| 6,525,183 B1 | 2/2003 | Vinayak et al. |
| 6,527,216 B2 | 3/2003 | Eagelman et al. |
| 6,528,262 B1 | 3/2003 | Gilad et al. |
| 6,534,312 B1 | 3/2003 | Shiver et al. |
| 6,552,006 B2 | 4/2003 | Raz et al. |
| 6,555,525 B2 | 4/2003 | Burke |
| 6,565,572 B2 | 5/2003 | Chappuis |
| 6,572,857 B1 | 6/2003 | Casimiro et al. |
| 6,586,524 B2 | 7/2003 | Sagara |
| 6,589,940 B1 | 7/2003 | Raz et al. |
| 6,610,044 B2 | 8/2003 | Mathiesen |
| 6,610,661 B1 | 8/2003 | Carson et al. |
| 6,613,026 B1 | 9/2003 | Palasis et al. |
| 6,617,106 B1 | 9/2003 | Benner |
| 6,623,457 B1 | 9/2003 | Rosenberg |
| 6,652,886 B2 | 11/2003 | Ahn et al. |
| 6,653,468 B1 | 11/2003 | Guzaev et al. |
| 6,664,066 B2 | 12/2003 | Parks |
| 6,670,178 B1 | 12/2003 | Selden et al. |
| 6,676,938 B1 | 1/2004 | Teti et al. |
| 6,696,038 B1 | 2/2004 | Mahato et al. |
| 6,743,211 B1 | 6/2004 | Prausnitz et al. |
| 6,743,823 B1 | 6/2004 | Summar et al. |
| 6,777,187 B2 | 8/2004 | Makarov et al. |
| 6,808,888 B2 | 10/2004 | Zhang et al. |
| 6,818,421 B2 | 11/2004 | Kossmann et al. |
| 6,835,393 B2 | 12/2004 | Hoffman et al. |
| 6,835,827 B2 | 12/2004 | Vinayak et al. |
| 6,890,319 B1 | 5/2005 | Crocker |
| 6,896,885 B2 | 5/2005 | Hanna |
| 6,900,302 B2 | 5/2005 | Teti et al. |
| 6,902,734 B2 | 6/2005 | Giles-Komar et al. |
| 6,924,365 B1 | 8/2005 | Miller et al. |
| 6,949,245 B1 | 9/2005 | Sliwkowski |
| 6,960,193 B2 | 11/2005 | Rosenberg |
| 6,962,694 B1 | 11/2005 | Soegaard et al. |
| 7,001,890 B1 | 2/2006 | Wagner et al. |
| 7,052,891 B2 | 5/2006 | Leung et al. |
| 7,074,596 B2 | 7/2006 | Darzynkiewicz et al. |
| 7,125,554 B2 | 10/2006 | Forsberg et al. |
| 7,135,010 B2 | 11/2006 | Buckman et al. |
| 7,195,761 B2 | 3/2007 | Holtzman et al. |
| 7,198,899 B2 | 4/2007 | Schleyer et al. |
| 7,202,226 B2 | 4/2007 | Murray et al. |

(56) References Cited

U.S. PATENT DOCUMENTS

| | | |
|---|---|---|
| 7,208,478 B2 | 4/2007 | Carson et al. |
| 7,226,439 B2 | 6/2007 | Prausnitz et al. |
| 7,226,595 B2 | 6/2007 | Antonsson et al. |
| 7,268,120 B1 | 9/2007 | Horton et al. |
| 7,276,489 B2 | 10/2007 | Agrawal et al. |
| 7,316,925 B2 | 1/2008 | Draghia-Akli et al. |
| 7,320,961 B2 | 1/2008 | Kempf et al. |
| 7,329,741 B2 | 2/2008 | Duhl |
| 7,335,471 B2 | 2/2008 | Guillerez et al. |
| 7,348,004 B2 | 3/2008 | Peters et al. |
| 7,354,742 B2 | 4/2008 | Kamme et al. |
| 7,371,404 B2 | 5/2008 | Panzner et al. |
| 7,374,778 B2 | 5/2008 | Hoffman et al. |
| 7,374,930 B2 | 5/2008 | Oh et al. |
| 7,378,262 B2 | 5/2008 | Sobek et al. |
| 7,384,739 B2 | 6/2008 | Kitabayashi et al. |
| 7,404,956 B2 | 7/2008 | Peters et al. |
| 7,422,739 B2 | 9/2008 | Anderson et al. |
| 7,476,506 B2 | 1/2009 | Schleyer et al. |
| 7,476,709 B2 | 1/2009 | Moody et al. |
| 7,479,543 B2 | 1/2009 | Tsuchiya et al. |
| 7,498,414 B2 | 3/2009 | Zhu |
| 7,501,486 B2 | 3/2009 | Zhang et al. |
| 7,521,054 B2 | 4/2009 | Pastan et al. |
| 7,547,678 B2 | 6/2009 | Kempf et al. |
| 7,550,264 B2 | 6/2009 | Getts et al. |
| 7,575,572 B2 | 8/2009 | Sweeney |
| 7,579,318 B2 | 8/2009 | Divita et al. |
| 7,615,225 B2 | 11/2009 | Forsberg et al. |
| 7,629,311 B2 | 12/2009 | Tobinick |
| 7,641,901 B2 | 1/2010 | Goldenberg et al. |
| 7,667,033 B2 | 2/2010 | Alvarado |
| 7,682,612 B1 | 3/2010 | White et al. |
| 7,699,852 B2 | 4/2010 | Frankel et al. |
| 7,708,994 B2 | 5/2010 | Benyunes |
| 7,709,452 B2 | 5/2010 | Pitard |
| 7,718,425 B2 | 5/2010 | Reinke et al. |
| 7,737,108 B1 | 6/2010 | Hoffman et al. |
| 7,745,391 B2 | 6/2010 | Mintz et al. |
| 7,763,253 B2 | 7/2010 | Hedlund et al. |
| 7,776,523 B2 | 8/2010 | Garcia et al. |
| 7,794,719 B2 | 9/2010 | Bardroff et al. |
| 7,799,900 B2 | 9/2010 | Adams et al. |
| 7,820,161 B1 | 10/2010 | Curd et al. |
| 7,820,624 B2 | 10/2010 | Hart et al. |
| 7,829,092 B2 | 11/2010 | Lobb et al. |
| 7,846,895 B2 | 12/2010 | Eckert et al. |
| 7,862,820 B2 | 1/2011 | Peters et al. |
| 7,884,184 B2 | 2/2011 | DeGroot et al. |
| 7,906,490 B2 | 3/2011 | Kool |
| 7,943,168 B2 | 5/2011 | Schlesinger et al. |
| 7,943,581 B2 | 5/2011 | Divita et al. |
| 7,964,571 B2 | 6/2011 | Fewell et al. |
| 7,999,087 B2 | 8/2011 | Dellinger et al. |
| 8,003,129 B2 | 8/2011 | Hoffman et al. |
| 8,008,449 B2 | 8/2011 | Korman et al. |
| 8,039,214 B2 | 10/2011 | Dahl et al. |
| 8,048,999 B2 | 11/2011 | Yamanaka et al. |
| 8,057,821 B2 | 11/2011 | Slobodkin et al. |
| 8,058,069 B2 | 11/2011 | Yaworski et al. |
| 8,101,385 B2 | 1/2012 | Cload et al. |
| 8,105,596 B2 | 1/2012 | Goldenberg et al. |
| 8,108,385 B2 | 1/2012 | Kraft et al. |
| 8,137,911 B2 | 3/2012 | Dahl et al. |
| 8,153,768 B2 | 4/2012 | Kunz et al. |
| 8,158,360 B2 | 4/2012 | Heise et al. |
| 8,158,601 B2 | 4/2012 | Chen et al. |
| 8,178,660 B2 | 5/2012 | Weiner et al. |
| 8,183,345 B2 | 5/2012 | Fay et al. |
| 8,183,352 B2 | 5/2012 | Ayyavoo et al. |
| 8,202,983 B2 | 6/2012 | Dellinger et al. |
| 8,217,016 B2 | 7/2012 | Hoerr et al. |
| 8,226,950 B2 | 7/2012 | Lobb et al. |
| 8,242,081 B2 | 8/2012 | Divita et al. |
| 8,242,087 B2 | 8/2012 | Adelfinskaya et al. |
| 8,242,258 B2 | 8/2012 | Dellinger et al. |
| 8,246,958 B2 | 8/2012 | Bendig et al. |
| 8,278,036 B2 | 10/2012 | Kariko et al. |
| 8,304,183 B2 | 11/2012 | Sooknanan |
| 8,304,532 B2 | 11/2012 | Adamo et al. |
| 8,309,706 B2 | 11/2012 | Dellinger et al. |
| 8,329,172 B2 | 12/2012 | Grillo-Lopez et al. |
| 8,329,182 B2 | 12/2012 | Peters et al. |
| 8,329,887 B2 | 12/2012 | Dahl et al. |
| 8,333,799 B2 | 12/2012 | Bales, Jr. et al. |
| 8,344,153 B2 | 1/2013 | Cottrell et al. |
| 8,349,321 B2 | 1/2013 | Burke et al. |
| 8,367,328 B2 | 2/2013 | Asada et al. |
| 8,367,631 B2 | 2/2013 | Pitard |
| 8,383,340 B2 | 2/2013 | Ketterer et al. |
| 8,394,763 B2 | 3/2013 | Forte et al. |
| 8,399,007 B2 | 3/2013 | Taft et al. |
| 8,404,222 B2 | 3/2013 | Harris |
| 8,404,799 B2 | 3/2013 | Podobinski et al. |
| 8,414,927 B2 | 4/2013 | Richard |
| 8,415,325 B2 | 4/2013 | Kiick et al. |
| 8,420,123 B2 | 4/2013 | Troiano et al. |
| 8,420,605 B2 | 4/2013 | Ulijn et al. |
| 8,431,160 B2 | 4/2013 | O'Hagan et al. |
| 8,435,504 B2 | 5/2013 | Kozlowski et al. |
| 8,440,231 B2 | 5/2013 | Smyth et al. |
| 8,440,614 B2 | 5/2013 | Castor |
| 8,444,992 B2 | 5/2013 | Borkowski et al. |
| 8,449,884 B2 | 5/2013 | Rivera et al. |
| 8,449,916 B1 | 5/2013 | Bellaire et al. |
| 8,450,298 B2 | 5/2013 | Mahon et al. |
| 8,454,946 B2 | 6/2013 | Shen et al. |
| 8,454,948 B2 | 6/2013 | Pearlman et al. |
| 8,460,696 B2 | 6/2013 | Slobodkin et al. |
| 8,460,709 B2 | 6/2013 | Ausborn et al. |
| 8,461,132 B2 | 6/2013 | Cohen et al. |
| 8,466,122 B2 | 6/2013 | Heyes et al. |
| 8,470,560 B2 | 6/2013 | Bergmann-Leitner et al. |
| 8,470,771 B2 | 6/2013 | Gao et al. |
| 8,476,234 B2 | 7/2013 | Fima et al. |
| 8,496,945 B2 | 7/2013 | Schlesinger et al. |
| 8,506,928 B2 | 8/2013 | Ferrara et al. |
| 8,506,966 B2 | 8/2013 | Podda et al. |
| 8,512,964 B2 | 8/2013 | Tontonoz et al. |
| 8,518,871 B2 | 8/2013 | Hsu et al. |
| 8,519,110 B2 | 8/2013 | Kowalska et al. |
| 8,529,538 B2 | 9/2013 | Pang et al. |
| 8,529,939 B2 | 9/2013 | Masters et al. |
| 8,530,429 B2 | 9/2013 | Robbins et al. |
| 8,530,625 B2 | 9/2013 | Kaplan et al. |
| 8,535,655 B2 | 9/2013 | O'Shea et al. |
| 8,535,701 B2 | 9/2013 | Peery et al. |
| 8,535,702 B2 | 9/2013 | Richard et al. |
| 8,545,843 B2 | 10/2013 | Curd et al. |
| 8,557,231 B2 | 10/2013 | Langer et al. |
| 8,557,244 B1 | 10/2013 | White et al. |
| 8,562,992 B2 | 10/2013 | Adams et al. |
| 8,563,041 B2 | 10/2013 | Grayson et al. |
| 8,568,784 B2 | 10/2013 | Lillard et al. |
| 8,569,256 B2 | 10/2013 | Heyes et al. |
| 8,580,297 B2 | 11/2013 | Essler et al. |
| 8,603,499 B2 | 12/2013 | Zale et al. |
| 8,603,500 B2 | 12/2013 | Zale et al. |
| 8,603,501 B2 | 12/2013 | Zale et al. |
| 8,603,534 B2 | 12/2013 | Zale et al. |
| 8,603,535 B2 | 12/2013 | Troiano et al. |
| 8,609,142 B2 | 12/2013 | Troiano et al. |
| 8,609,822 B2 | 12/2013 | Elson et al. |
| 8,613,951 B2 | 12/2013 | Zale et al. |
| 8,613,954 B2 | 12/2013 | Zale et al. |
| 8,617,608 B2 | 12/2013 | Zale et al. |
| 8,618,240 B2 | 12/2013 | Podobinski et al. |
| 8,623,367 B2 | 1/2014 | Momm et al. |
| 8,628,801 B2 | 1/2014 | Garreta et al. |
| 8,636,696 B2 | 1/2014 | Ross et al. |
| 8,636,994 B2 | 1/2014 | Bossard et al. |
| 8,637,028 B2 | 1/2014 | Alexis et al. |
| 8,637,083 B2 | 1/2014 | Troiano et al. |
| 8,642,076 B2 | 2/2014 | Manoharan et al. |

(56) References Cited

U.S. PATENT DOCUMENTS

| | | |
|---|---|---|
| 8,652,487 B2 | 2/2014 | Maldonado |
| 8,652,528 B2 | 2/2014 | Troiano et al. |
| 8,658,211 B2 | 2/2014 | Rozema et al. |
| 8,658,733 B2 | 2/2014 | Jorgedal et al. |
| 8,663,599 B1 | 3/2014 | Sung et al. |
| 8,663,692 B1 | 3/2014 | Muller et al. |
| 8,663,700 B2 | 3/2014 | Troiano et al. |
| 8,668,926 B1 | 3/2014 | Mousa et al. |
| 8,685,368 B2 | 4/2014 | Reineke |
| 8,685,458 B2 | 4/2014 | Miller et al. |
| 8,691,223 B2 | 4/2014 | Van Den Brink et al. |
| 8,691,750 B2 | 4/2014 | Constein et al. |
| 8,691,785 B2 | 4/2014 | Teng et al. |
| 8,691,963 B2 | 4/2014 | Brahmbhatt et al. |
| 8,696,637 B2 | 4/2014 | Ross |
| 8,697,098 B2 | 4/2014 | Perumal et al. |
| 8,703,204 B2 | 4/2014 | Bloom et al. |
| 8,709,483 B2 | 4/2014 | Farokhzad et al. |
| 8,715,677 B2 | 5/2014 | Bartlett et al. |
| 8,715,689 B2 | 5/2014 | Kinney et al. |
| 8,715,694 B2 | 5/2014 | Apt et al. |
| 8,715,736 B2 | 5/2014 | Sachdeva et al. |
| 8,715,741 B2 | 5/2014 | Maitra et al. |
| 8,722,341 B2 | 5/2014 | Fouchier et al. |
| 8,728,491 B2 | 5/2014 | Sesardic et al. |
| 8,728,527 B2 | 5/2014 | Singh et al. |
| 8,728,772 B2 | 5/2014 | Suzuki et al. |
| 8,734,832 B2 | 5/2014 | O'hagan et al. |
| 8,734,846 B2 | 5/2014 | Ali et al. |
| 8,734,853 B2 | 5/2014 | Sood et al. |
| 8,735,566 B2 | 5/2014 | Brahmbhatt et al. |
| 8,735,570 B2 | 5/2014 | Miller et al. |
| 2001/0001066 A1 | 5/2001 | Cezayirli et al. |
| 2001/0005506 A1 | 6/2001 | Cezayirli et al. |
| 2001/0014753 A1 | 8/2001 | Soloveichik et al. |
| 2002/0001842 A1 | 1/2002 | Chapman et al. |
| 2002/0064517 A1 | 5/2002 | Cederholm-Williams |
| 2002/0111471 A1 | 8/2002 | Lo et al. |
| 2002/0123099 A1 | 9/2002 | Weiner et al. |
| 2002/0123723 A1 | 9/2002 | Sorenson et al. |
| 2002/0127592 A1 | 9/2002 | Ichihara et al. |
| 2002/0130430 A1 | 9/2002 | Castor et al. |
| 2002/0132788 A1 | 9/2002 | Lewis et al. |
| 2002/0143204 A1 | 10/2002 | Evain et al. |
| 2003/0026841 A1 | 2/2003 | Trubetskoy et al. |
| 2003/0032615 A1 | 2/2003 | Felgner et al. |
| 2003/0050468 A1 | 3/2003 | Shiver et al. |
| 2003/0073619 A1 | 4/2003 | Mahato et al. |
| 2003/0077604 A1 | 4/2003 | Sun et al. |
| 2003/0082768 A1 | 5/2003 | Baskerville et al. |
| 2003/0083272 A1 | 5/2003 | Wiederholt et al. |
| 2003/0092653 A1* | 5/2003 | Kisich et al. .................. 514/44 |
| 2003/0138419 A1 | 7/2003 | Radic et al. |
| 2003/0143743 A1 | 7/2003 | Schuler et al. |
| 2003/0153735 A1 | 8/2003 | Breece et al. |
| 2003/0158133 A1 | 8/2003 | Movsesian |
| 2003/0170273 A1 | 9/2003 | O'Hagan et al. |
| 2003/0171253 A1 | 9/2003 | Ma et al. |
| 2003/0186237 A1 | 10/2003 | Ginsberg et al. |
| 2003/0191303 A1 | 10/2003 | Vinayak et al. |
| 2003/0192068 A1 | 10/2003 | Deboer et al. |
| 2003/0225016 A1 | 12/2003 | Fearon et al. |
| 2004/0005667 A1 | 1/2004 | Ratti et al. |
| 2004/0018525 A1 | 1/2004 | Wirtz et al. |
| 2004/0106567 A1 | 6/2004 | Hagstrom et al. |
| 2004/0110191 A1 | 6/2004 | Winkler et al. |
| 2004/0122216 A1 | 6/2004 | Nielsen et al. |
| 2004/0142474 A1 | 7/2004 | Mahato et al. |
| 2004/0147027 A1 | 7/2004 | Troy et al. |
| 2004/0167090 A1 | 8/2004 | Monahan et al. |
| 2004/0171041 A1 | 9/2004 | Dahl et al. |
| 2004/0171980 A1 | 9/2004 | Mitragotri et al. |
| 2004/0197802 A1 | 10/2004 | Dahl et al. |
| 2004/0202658 A1 | 10/2004 | Benyunes |
| 2004/0209274 A2 | 10/2004 | Daly |
| 2004/0236268 A1 | 11/2004 | Mitragotri et al. |
| 2004/0259081 A1 | 12/2004 | Watzele et al. |
| 2005/0032730 A1 | 2/2005 | Von Der Mulbe et al. |
| 2005/0037494 A1 | 2/2005 | Hecker et al. |
| 2005/0054026 A1 | 3/2005 | Atsushi et al. |
| 2005/0059624 A1 | 3/2005 | Hoerr et al. |
| 2005/0064596 A1 | 3/2005 | Riemen et al. |
| 2005/0089913 A1 | 4/2005 | Williams |
| 2005/0112141 A1 | 5/2005 | Terman |
| 2005/0130201 A1 | 6/2005 | Deras et al. |
| 2005/0137155 A1 | 6/2005 | McSwiggen et al. |
| 2005/0147618 A1 | 7/2005 | Rivera et al. |
| 2005/0153333 A1 | 7/2005 | Sooknanan |
| 2005/0181016 A1 | 8/2005 | Freyman et al. |
| 2005/0232919 A1 | 10/2005 | Grasso et al. |
| 2005/0250723 A1 | 11/2005 | Hoerr et al. |
| 2006/0008910 A1 | 1/2006 | MacLachlan et al. |
| 2006/0018971 A1 | 1/2006 | Scott et al. |
| 2006/0032372 A1 | 2/2006 | Dauber et al. |
| 2006/0035226 A1 | 2/2006 | Scheinert et al. |
| 2006/0057111 A1 | 3/2006 | Hedlund et al. |
| 2006/0083780 A1 | 4/2006 | Heyes et al. |
| 2006/0160743 A1 | 7/2006 | Zhang et al. |
| 2006/0172003 A1 | 8/2006 | Meers et al. |
| 2006/0172966 A1 | 8/2006 | Lipford et al. |
| 2006/0188490 A1 | 8/2006 | Hoerr et al. |
| 2006/0204566 A1 | 9/2006 | Smyth-Templeton et al. |
| 2006/0241076 A1 | 10/2006 | Uhlmann et al. |
| 2006/0247195 A1 | 11/2006 | Ray |
| 2006/0265771 A1 | 11/2006 | Lewis et al. |
| 2006/0275747 A1 | 12/2006 | Hardy et al. |
| 2007/0037147 A1 | 2/2007 | Garcia et al. |
| 2007/0037148 A1 | 2/2007 | Fong et al. |
| 2007/0048741 A1 | 3/2007 | Getts et al. |
| 2007/0054278 A1 | 3/2007 | Cargill |
| 2007/0072175 A1 | 3/2007 | Cooper et al. |
| 2007/0087437 A1 | 4/2007 | Hu |
| 2007/0105124 A1 | 5/2007 | Getts et al. |
| 2007/0117112 A1 | 5/2007 | Diener et al. |
| 2007/0122882 A1 | 5/2007 | Nakagawa et al. |
| 2007/0141030 A1 | 6/2007 | Yu et al. |
| 2007/0143878 A1 | 6/2007 | Bhat et al. |
| 2007/0178103 A1 | 8/2007 | Fey et al. |
| 2007/0213287 A1 | 9/2007 | Fewell et al. |
| 2007/0224635 A1 | 9/2007 | Bouquin |
| 2007/0252295 A1 | 11/2007 | Panzner et al. |
| 2007/0265220 A1 | 11/2007 | Rossi et al. |
| 2007/0280929 A1 | 12/2007 | Hoerr et al. |
| 2008/0008711 A1 | 1/2008 | Schleyer et al. |
| 2008/0020431 A1 | 1/2008 | Getts et al. |
| 2008/0025944 A1 | 1/2008 | Hoerr et al. |
| 2008/0075698 A1 | 3/2008 | Sawada et al. |
| 2008/0076174 A1 | 3/2008 | Selden |
| 2008/0119645 A1 | 5/2008 | Griffey et al. |
| 2008/0166414 A1 | 7/2008 | Hanes et al. |
| 2008/0166793 A1 | 7/2008 | Beer et al. |
| 2008/0171711 A1 | 7/2008 | Hoerr et al. |
| 2008/0220471 A1 | 9/2008 | Davis et al. |
| 2008/0260706 A1 | 10/2008 | Rabinovich et al. |
| 2008/0261905 A1 | 10/2008 | Herdewijn et al. |
| 2008/0267873 A1 | 10/2008 | Hoerr et al. |
| 2008/0274463 A1 | 11/2008 | Chen et al. |
| 2008/0275468 A1 | 11/2008 | Chuang et al. |
| 2008/0286813 A1 | 11/2008 | George-Hyslop et al. |
| 2008/0293143 A1 | 11/2008 | Lin et al. |
| 2009/0042829 A1 | 2/2009 | Matar et al. |
| 2009/0048167 A1 | 2/2009 | Hillman |
| 2009/0053775 A1 | 2/2009 | Dahl et al. |
| 2009/0093433 A1 | 4/2009 | Woolf et al. |
| 2009/0144839 A1 | 6/2009 | Inana et al. |
| 2009/0169550 A1 | 7/2009 | Dummer |
| 2009/0170090 A1 | 7/2009 | Ignatov et al. |
| 2009/0208418 A1 | 8/2009 | Kohler et al. |
| 2009/0208500 A1 | 8/2009 | Joly et al. |
| 2009/0226470 A1 | 9/2009 | Mauro et al. |
| 2009/0227660 A1 | 9/2009 | Oh et al. |
| 2009/0264511 A1 | 10/2009 | de Fougerolles et al. |
| 2009/0281298 A1 | 11/2009 | Manoharan et al. |
| 2009/0286852 A1 | 11/2009 | Kariko et al. |

(56) References Cited

U.S. PATENT DOCUMENTS

| | | |
|---|---|---|
| 2009/0324584 A1 | 12/2009 | Hoerr et al. |
| 2010/0003337 A1 | 1/2010 | Hanes et al. |
| 2010/0004313 A1 | 1/2010 | Slobodkin et al. |
| 2010/0004315 A1 | 1/2010 | Slobodkin et al. |
| 2010/0009424 A1 | 1/2010 | Forde et al. |
| 2010/0009865 A1 | 1/2010 | Herdewijn et al. |
| 2010/0015232 A1 | 1/2010 | Besenbacher et al. |
| 2010/0021429 A1 | 1/2010 | Brentzel, Jr. et al. |
| 2010/0028943 A1 | 2/2010 | Thomas et al. |
| 2010/0047261 A1 | 2/2010 | Hoerr et al. |
| 2010/0086922 A1 | 4/2010 | Bryant et al. |
| 2010/0120024 A1 | 5/2010 | Cload et al. |
| 2010/0129877 A1 | 5/2010 | Sahin et al. |
| 2010/0137407 A1 | 6/2010 | Abe et al. |
| 2010/0178271 A1 | 7/2010 | Bridger et al. |
| 2010/0189729 A1 | 7/2010 | Hoerr et al. |
| 2010/0196318 A1 | 8/2010 | Lieberburg |
| 2010/0203076 A1 | 8/2010 | Fotin-Mleczek et al. |
| 2010/0215580 A1 | 8/2010 | Hanes et al. |
| 2010/0233141 A1 | 9/2010 | Polach et al. |
| 2010/0239608 A1 | 9/2010 | Von Der Mulbe et al. |
| 2010/0260817 A1 | 10/2010 | Slobodkin et al. |
| 2010/0261231 A1 | 10/2010 | Kore et al. |
| 2010/0266587 A1 | 10/2010 | McLachlan |
| 2010/0273220 A1 | 10/2010 | Yanik et al. |
| 2010/0285135 A1 | 11/2010 | Wendorf et al. |
| 2010/0291156 A1 | 11/2010 | Barner et al. |
| 2010/0293625 A1 | 11/2010 | Reed |
| 2010/0297750 A1 | 11/2010 | Natsume et al. |
| 2010/0305196 A1 | 12/2010 | Probst et al. |
| 2011/0002934 A1 | 1/2011 | Luqman et al. |
| 2011/0020352 A1 | 1/2011 | Garcia et al. |
| 2011/0045022 A1 | 2/2011 | Tsai |
| 2011/0053829 A1 | 3/2011 | Baumhof et al. |
| 2011/0065103 A1 | 3/2011 | Sahin et al. |
| 2011/0077287 A1 | 3/2011 | Von Der Mulbe et al. |
| 2011/0086904 A1 | 4/2011 | Russell |
| 2011/0091473 A1 | 4/2011 | Golab et al. |
| 2011/0091879 A1 | 4/2011 | Hillebrand et al. |
| 2011/0097716 A1 | 4/2011 | Natt et al. |
| 2011/0112040 A1 | 5/2011 | Liu et al. |
| 2011/0143397 A1 | 6/2011 | Kariko et al. |
| 2011/0143436 A1 | 6/2011 | Dahl et al. |
| 2011/0165123 A1 | 7/2011 | Hartmann et al. |
| 2011/0165159 A1 | 7/2011 | Grillo-Lopez et al. |
| 2011/0172126 A1 | 7/2011 | Brust |
| 2011/0182919 A1 | 7/2011 | Peters et al. |
| 2011/0200582 A1 | 8/2011 | Baryza et al. |
| 2011/0218231 A1 | 9/2011 | Fewell et al. |
| 2011/0244026 A1 | 10/2011 | Guild et al. |
| 2011/0245756 A1 | 10/2011 | Arora et al. |
| 2011/0247090 A1 | 10/2011 | Reed |
| 2011/0250225 A1 | 10/2011 | Fotin-Mleczek et al. |
| 2011/0269950 A1 | 11/2011 | Von Der Mulbe et al. |
| 2011/0274697 A1 | 11/2011 | Thomas et al. |
| 2011/0275793 A1 | 11/2011 | Debart et al. |
| 2011/0287006 A1 | 11/2011 | Friess et al. |
| 2011/0294717 A1 | 12/2011 | Ali et al. |
| 2011/0300205 A1 | 12/2011 | Geall et al. |
| 2011/0311472 A1 | 12/2011 | Hoerr et al. |
| 2012/0009145 A1 | 1/2012 | Slobodkin et al. |
| 2012/0009221 A1 | 1/2012 | Hoerr et al. |
| 2012/0009649 A1 | 1/2012 | Dahl et al. |
| 2012/0015899 A1 | 1/2012 | Lomonossoff et al. |
| 2012/0021043 A1 | 1/2012 | Kramps et al. |
| 2012/0027813 A1 | 2/2012 | Podda et al. |
| 2012/0046346 A1 | 2/2012 | Rossi et al. |
| 2012/0053333 A1 | 3/2012 | Mauro et al. |
| 2012/0060293 A1 | 3/2012 | Stelter et al. |
| 2012/0065252 A1 | 3/2012 | Schrum et al. |
| 2012/0076836 A1 | 3/2012 | Hori et al. |
| 2012/0094906 A1 | 4/2012 | Guyon et al. |
| 2012/0095077 A1 | 4/2012 | Burrows et al. |
| 2012/0114686 A1 | 5/2012 | Schneewind et al. |
| 2012/0121718 A1 | 5/2012 | Lai et al. |
| 2012/0128699 A1 | 5/2012 | Kandimalla et al. |
| 2012/0129759 A1 | 5/2012 | Liu et al. |
| 2012/0156679 A1 | 6/2012 | Dahl et al. |
| 2012/0171290 A1 | 7/2012 | Coursaget et al. |
| 2012/0177724 A1 | 7/2012 | Irvine et al. |
| 2012/0178702 A1 | 7/2012 | Huang |
| 2012/0189700 A1 | 7/2012 | Aguilar et al. |
| 2012/0195917 A1 | 8/2012 | Sahin et al. |
| 2012/0195936 A1 | 8/2012 | Rudolph et al. |
| 2012/0207840 A1 | 8/2012 | de los Pinos |
| 2012/0213818 A1 | 8/2012 | Hoerr et al. |
| 2012/0219573 A1 | 8/2012 | Baumhof et al. |
| 2012/0225070 A1 | 9/2012 | Smith et al. |
| 2012/0232133 A1 | 9/2012 | Balazs et al. |
| 2012/0237975 A1 | 9/2012 | Schrum et al. |
| 2012/0251618 A1 | 10/2012 | Schrum et al. |
| 2012/0252117 A1 | 10/2012 | Selden et al. |
| 2012/0258046 A1 | 10/2012 | Mutske |
| 2012/0276048 A1 | 11/2012 | Panzara et al. |
| 2012/0282247 A1 | 11/2012 | Schneewind et al. |
| 2012/0282249 A1 | 11/2012 | Fox et al. |
| 2012/0295832 A1 | 11/2012 | Constien et al. |
| 2012/0301955 A1 | 11/2012 | Thomas et al. |
| 2012/0321719 A1 | 12/2012 | McDonnell et al. |
| 2012/0322864 A1 | 12/2012 | Rossi et al. |
| 2012/0322865 A1 | 12/2012 | Rossi et al. |
| 2013/0012426 A1 | 1/2013 | de los Pinos |
| 2013/0012450 A1 | 1/2013 | de los Pinos |
| 2013/0012566 A1 | 1/2013 | De Los Pinos |
| 2013/0017223 A1 | 1/2013 | Hope et al. |
| 2013/0017265 A1 | 1/2013 | Farokhzad et al. |
| 2013/0022538 A1 | 1/2013 | Rossi |
| 2013/0029418 A1 | 1/2013 | Angel et al. |
| 2013/0059360 A1 | 3/2013 | Bossard et al. |
| 2013/0064894 A1 | 3/2013 | Martin et al. |
| 2013/0065942 A1 | 3/2013 | Matar et al. |
| 2013/0071450 A1 | 3/2013 | Copp-Howland |
| 2013/0072670 A1 | 3/2013 | Srivastava et al. |
| 2013/0072709 A1 | 3/2013 | McManus et al. |
| 2013/0084289 A1 | 4/2013 | Curd et al. |
| 2013/0090287 A1 | 4/2013 | Alessi et al. |
| 2013/0090372 A1 | 4/2013 | Budzik et al. |
| 2013/0102034 A1 | 4/2013 | Schrum |
| 2013/0102545 A1 | 4/2013 | Gao et al. |
| 2013/0108629 A1 | 5/2013 | Dumont et al. |
| 2013/0111615 A1 | 5/2013 | Kariko et al. |
| 2013/0115192 A1 | 5/2013 | Ali et al. |
| 2013/0115196 A1 | 5/2013 | Hantash et al. |
| 2013/0115247 A1 | 5/2013 | de Los Pinos |
| 2013/0115272 A1 | 5/2013 | De Fougerolles et al. |
| 2013/0115273 A1 | 5/2013 | Yang et al. |
| 2013/0115274 A1 | 5/2013 | Knopov et al. |
| 2013/0115293 A1 | 5/2013 | Sabnis et al. |
| 2013/0116408 A1 | 5/2013 | de Los Pinos |
| 2013/0121954 A1 | 5/2013 | Wakefield et al. |
| 2013/0121988 A1 | 5/2013 | Hoerr et al. |
| 2013/0122104 A1 | 5/2013 | Yaworski et al. |
| 2013/0123338 A1 | 5/2013 | Heyes et al. |
| 2013/0123351 A1 | 5/2013 | Dewitt |
| 2013/0129627 A1 | 5/2013 | Delehanty et al. |
| 2013/0129726 A1 | 5/2013 | Lee et al. |
| 2013/0129785 A1 | 5/2013 | Manoharan et al. |
| 2013/0129794 A1 | 5/2013 | Kleiner et al. |
| 2013/0129830 A1 | 5/2013 | Chen et al. |
| 2013/0130348 A1 | 5/2013 | Gu et al. |
| 2013/0133483 A1 | 5/2013 | Yang et al. |
| 2013/0136746 A1 | 5/2013 | Schneewind |
| 2013/0137644 A1 | 5/2013 | Alluis et al. |
| 2013/0138032 A1 | 5/2013 | Kim et al. |
| 2013/0142818 A1 | 6/2013 | Baumhof et al. |
| 2013/0142868 A1 | 6/2013 | Hoekman et al. |
| 2013/0142876 A1 | 6/2013 | Howard et al. |
| 2013/0149318 A1 | 6/2013 | Reynolds et al. |
| 2013/0149375 A1 | 6/2013 | Geall |
| 2013/0149783 A1 | 6/2013 | Yockman et al. |
| 2013/0150295 A1 | 6/2013 | Jaworowicz |
| 2013/0150625 A1 | 6/2013 | Budzik et al. |
| 2013/0150822 A1 | 6/2013 | Ross |
| 2013/0156721 A1 | 6/2013 | Cheng et al. |

(56) References Cited

U.S. PATENT DOCUMENTS

| | | |
|---|---|---|
| 2013/0156776 A1 | 6/2013 | Chang et al. |
| 2013/0156845 A1 | 6/2013 | Manoharan et al. |
| 2013/0164219 A1 | 6/2013 | Brinkmann et al. |
| 2013/0164343 A1 | 6/2013 | Hanes et al. |
| 2013/0164348 A1 | 6/2013 | Palasis et al. |
| 2013/0164400 A1 | 6/2013 | Knopov et al. |
| 2013/0165499 A1 | 6/2013 | Vaishnaw et al. |
| 2013/0165772 A1 | 6/2013 | Traverso et al. |
| 2013/0171138 A1 | 7/2013 | Peters et al. |
| 2013/0171175 A1 | 7/2013 | Pierce et al. |
| 2013/0171183 A1 | 7/2013 | Schneewind |
| 2013/0171241 A1 | 7/2013 | Geall |
| 2013/0171646 A1 | 7/2013 | Park et al. |
| 2013/0172406 A1 | 7/2013 | Zale et al. |
| 2013/0172600 A1 | 7/2013 | Chang et al. |
| 2013/0177499 A1 | 7/2013 | Brahmbhatt et al. |
| 2013/0177523 A1 | 7/2013 | Ghandehari et al. |
| 2013/0177587 A1 | 7/2013 | Robinson et al. |
| 2013/0177611 A1 | 7/2013 | Kaplan et al. |
| 2013/0177633 A1 | 7/2013 | Schutt et al. |
| 2013/0177634 A1 | 7/2013 | Schutt et al. |
| 2013/0177635 A1 | 7/2013 | Schutt et al. |
| 2013/0177636 A1 | 7/2013 | Schutt et al. |
| 2013/0177637 A1 | 7/2013 | Schutt et al. |
| 2013/0177638 A1 | 7/2013 | Schutt et al. |
| 2013/0177639 A1 | 7/2013 | Geall et al. |
| 2013/0177640 A1 | 7/2013 | Geall et al. |
| 2013/0178541 A1 | 7/2013 | Stanton et al. |
| 2013/0183244 A1 | 7/2013 | Hanes et al. |
| 2013/0183355 A1 | 7/2013 | Jain et al. |
| 2013/0183372 A1 | 7/2013 | Schutt et al. |
| 2013/0183373 A1 | 7/2013 | Schutt et al. |
| 2013/0183375 A1 | 7/2013 | Schutt et al. |
| 2013/0183718 A1 | 7/2013 | Rohayem et al. |
| 2013/0184207 A1 | 7/2013 | Fares et al. |
| 2013/0184443 A1 | 7/2013 | Bentley et al. |
| 2013/0184453 A1 | 7/2013 | Davis et al. |
| 2013/0189295 A1 | 7/2013 | Arico et al. |
| 2013/0189351 A1 | 7/2013 | Geall |
| 2013/0189741 A1 | 7/2013 | Meis et al. |
| 2013/0195759 A1 | 8/2013 | Mirkin et al. |
| 2013/0195765 A1 | 8/2013 | Gho et al. |
| 2013/0195846 A1 | 8/2013 | Friess et al. |
| 2013/0195898 A1 | 8/2013 | O'Hagan et al. |
| 2013/0195967 A1 | 8/2013 | Guild et al. |
| 2013/0195968 A1 | 8/2013 | Geall et al. |
| 2013/0195969 A1 | 8/2013 | Geall et al. |
| 2013/0197068 A1 | 8/2013 | Kariko et al. |
| 2013/0202595 A1 | 8/2013 | Peirce et al. |
| 2013/0202645 A1 | 8/2013 | Barner et al. |
| 2013/0202684 A1 | 8/2013 | Geall et al. |
| 2013/0203115 A1 | 8/2013 | Schrum et al. |
| 2013/0209454 A1 | 8/2013 | Diskin et al. |
| 2013/0209456 A1 | 8/2013 | Kano et al. |
| 2013/0236419 A1 | 9/2013 | Schneewind et al. |
| 2013/0236500 A1 | 9/2013 | Zale et al. |
| 2013/0236533 A1 | 9/2013 | Von Andrian et al. |
| 2013/0236550 A1 | 9/2013 | Ausborn et al. |
| 2013/0236556 A1 | 9/2013 | Lai et al. |
| 2013/0236968 A1 | 9/2013 | Manoharan et al. |
| 2013/0243747 A1 | 9/2013 | Fima et al. |
| 2013/0243827 A1 | 9/2013 | Troiano et al. |
| 2013/0243848 A1 | 9/2013 | Lobovkina et al. |
| 2013/0243867 A1 | 9/2013 | Mohapatra et al. |
| 2013/0244972 A1 | 9/2013 | Ben-Shalom et al. |
| 2013/0245091 A1 | 9/2013 | Rozema et al. |
| 2013/0251679 A1 | 9/2013 | Pearlman et al. |
| 2013/0251766 A1 | 9/2013 | Zale et al. |
| 2013/0251816 A1 | 9/2013 | Zale et al. |
| 2013/0251817 A1 | 9/2013 | Zale et al. |
| 2013/0259923 A1 | 10/2013 | Bancel et al. |
| 2013/0266553 A1 | 10/2013 | Ballance et al. |
| 2013/0266611 A1 | 10/2013 | Rabinovich et al. |
| 2013/0266617 A1 | 10/2013 | Mirosevich et al. |
| 2013/0272994 A1 | 10/2013 | Fu et al. |
| 2013/0273039 A1 | 10/2013 | Grillo-Lopez |
| 2013/0273047 A1 | 10/2013 | Rivera et al. |
| 2013/0273081 A1 | 10/2013 | Monaci et al. |
| 2013/0273117 A1 | 10/2013 | Podobinski et al. |
| 2013/0274194 A1 | 10/2013 | Dumont et al. |
| 2013/0274504 A1 | 10/2013 | Colletti et al. |
| 2013/0274523 A1 | 10/2013 | Bawiec, III et al. |
| 2013/0280334 A1 | 10/2013 | Karp et al. |
| 2013/0280339 A1 | 10/2013 | Zale et al. |
| 2013/0281658 A1 | 10/2013 | Rozema et al. |
| 2013/0281671 A1 | 10/2013 | Peters et al. |
| 2013/0287832 A1 | 10/2013 | O'Hagan |
| 2013/0289093 A1 | 10/2013 | Bhat et al. |
| 2013/0295183 A1 | 11/2013 | Troiano et al. |
| 2013/0295191 A1 | 11/2013 | Troiano et al. |
| 2013/0302432 A1 | 11/2013 | Zale et al. |
| 2013/0302433 A1 | 11/2013 | Troiano et al. |
| 2013/0315831 A1 | 11/2013 | Shi et al. |
| 2013/0317079 A1 | 11/2013 | Wakefield et al. |
| 2013/0323179 A1 | 12/2013 | Popov et al. |
| 2013/0323310 A1 | 12/2013 | Smyth et al. |
| 2013/0330401 A1 | 12/2013 | Payne et al. |
| 2013/0338210 A1 | 12/2013 | Manoharan et al. |
| 2013/0344091 A1 | 12/2013 | Berger et al. |
| 2013/0344158 A1 | 12/2013 | Zale et al. |
| 2014/0005379 A1 | 1/2014 | Gu |
| 2014/0017327 A1 | 1/2014 | Cheng et al. |
| 2014/0017329 A1 | 1/2014 | Mousa |
| 2014/0030351 A1 | 1/2014 | Zale et al. |
| 2014/0037573 A1 | 2/2014 | Eliasof et al. |
| 2014/0037660 A1 | 2/2014 | Fotin-Mleczek et al. |
| 2014/0037714 A1 | 2/2014 | Quay et al. |
| 2014/0039032 A1 | 2/2014 | Kumboyama et al. |
| 2014/0044772 A1 | 2/2014 | MacLachlan et al. |
| 2014/0044791 A1 | 2/2014 | Basilion et al. |
| 2014/0045913 A1 | 2/2014 | Kuboyama et al. |
| 2014/0045950 A1 | 2/2014 | Lacko et al. |
| 2014/0050775 A1 | 2/2014 | Slobodkin et al. |
| 2014/0056867 A1 | 2/2014 | Lebowitz et al. |
| 2014/0056970 A1 | 2/2014 | Panzer et al. |
| 2014/0057109 A1 | 2/2014 | Mechen et al. |
| 2014/0065172 A1 | 3/2014 | Echeverri et al. |
| 2014/0065204 A1 | 3/2014 | Hayes et al. |
| 2014/0065228 A1 | 3/2014 | Yarowoski et al. |
| 2014/0066363 A1 | 3/2014 | Bhunia et al. |
| 2014/0073715 A1 | 3/2014 | Fonnum et al. |
| 2014/0073738 A1 | 3/2014 | Fonnum et al. |
| 2014/0079774 A1 | 3/2014 | Brinker et al. |
| 2014/0079776 A1 | 3/2014 | Lippard et al. |
| 2014/0080766 A1 | 3/2014 | Pirie et al. |
| 2014/0081012 A1 | 3/2014 | DeSimone et al. |
| 2014/0093575 A1 | 4/2014 | Hammond et al. |
| 2014/0093579 A1 | 4/2014 | Zale et al. |
| 2014/0100178 A1 | 4/2014 | Ansari et al. |
| 2014/0106260 A1 | 4/2014 | Cargnello et al. |
| 2014/0107227 A1 | 4/2014 | Masters et al. |
| 2014/0107229 A1 | 4/2014 | Kormann et al. |
| 2014/0107349 A1 | 4/2014 | Bentley et al. |
| 2014/0107594 A1 | 4/2014 | Guo et al. |
| 2014/0113137 A1 | 4/2014 | Podobinski et al. |
| 2014/0121263 A1 | 5/2014 | Fitzgerald et al. |
| 2014/0121393 A1 | 5/2014 | Manoharan et al. |
| 2014/0121587 A1 | 5/2014 | Sallberg et al. |
| 2014/0127227 A1 | 5/2014 | Chang |
| 2014/0127301 A1 | 5/2014 | Alexis et al. |
| 2014/0128269 A1 | 5/2014 | Hinz et al. |
| 2014/0128329 A1 | 5/2014 | Gore et al. |
| 2014/0134129 A1 | 5/2014 | Thalhamer et al. |
| 2014/0134201 A1 | 5/2014 | Tureci et al. |
| 2014/0134230 A1 | 5/2014 | Frank et al. |
| 2014/0135380 A1 | 5/2014 | Hadwiger et al. |
| 2014/0135381 A1 | 5/2014 | Hadwiger et al. |
| 2014/0141025 A1 | 5/2014 | Kudirka et al. |
| 2014/0141070 A1 | 5/2014 | Geall et al. |
| 2014/0141089 A1 | 5/2014 | Liang |
| 2014/0141483 A1 | 5/2014 | Bossard et al. |
| 2014/0142165 A1 | 5/2014 | Grayson et al. |
| 2014/0142254 A1 | 5/2014 | Fonnum et al. |
| 2014/0147432 A1 | 5/2014 | Bancel et al. |

(56) References Cited

U.S. PATENT DOCUMENTS

| | | | |
|---|---|---|---|
| 2014/0147454 A1 | 5/2014 | Chakraborty et al. | |
| 2014/0148502 A1 | 5/2014 | Bancel et al. | |
| 2014/0148503 A1 | 5/2014 | Giangrande et al. | |

FOREIGN PATENT DOCUMENTS

| | | |
|---|---|---|
| CA | 2795695 | 10/2011 |
| EP | 0194809 | 3/1986 |
| EP | 0204401 | 12/1986 |
| EP | 0366400 | 5/1990 |
| EP | 0427073 | 5/1991 |
| EP | 0427074 | 5/1991 |
| EP | 0735144 B1 | 3/1996 |
| EP | 0726319 | 8/1996 |
| EP | 0737750 | 10/1996 |
| EP | 0771873 A3 | 7/1997 |
| EP | 0839912 | 5/1998 |
| EP | 0969862 | 1/2000 |
| EP | 1026253 | 8/2000 |
| EP | 1083732 B1 | 3/2001 |
| EP | 1404860 | 5/2002 |
| EP | 1224943 | 7/2002 |
| EP | 1361277 | 11/2003 |
| EP | 1393745 | 3/2004 |
| EP | 1083232 | 2/2005 |
| EP | 1301614 | 11/2006 |
| EP | 1873180 A1 | 1/2008 |
| EP | 1905844 A2 | 2/2008 |
| EP | 1964922 A1 | 3/2008 |
| EP | 2072618 | 6/2009 |
| EP | 1056873 | 3/2010 |
| EP | 2191840 | 6/2010 |
| EP | 2092064 | 9/2010 |
| EP | 2246422 | 11/2010 |
| EP | 1619254 | 12/2010 |
| EP | 2292771 | 3/2011 |
| EP | 2377938 | 10/2011 |
| EP | 2468290 A1 | 6/2012 |
| EP | 2476430 B1 | 7/2012 |
| EP | 2484770 | 8/2012 |
| EP | 1907590 | 9/2012 |
| EP | 2535419 | 12/2012 |
| EP | 2188379 | 1/2013 |
| EP | 2548960 | 1/2013 |
| EP | 2620161 | 7/2013 |
| EP | 2623121 | 7/2013 |
| EP | 2073848 | 8/2013 |
| EP | 2623121 | 8/2013 |
| EP | 2695608 A2 | 2/2014 |
| EP | 2160464 B1 | 5/2014 |
| EP | 2607379 B1 | 5/2014 |
| EP | 2732825 A1 | 5/2014 |
| WO | 89/07947 A1 | 3/1989 |
| WO | 8906700 | 7/1989 |
| WO | 8909622 A1 | 10/1989 |
| WO | 9011092 | 10/1990 |
| WO | 9201813 A1 | 2/1992 |
| WO | 92/16553 A1 | 10/1992 |
| WO | 9309236 | 5/1993 |
| WO | 9314778 | 8/1993 |
| WO | 9512665 | 5/1995 |
| WO | 9524485 | 9/1995 |
| WO | 9526204 | 10/1995 |
| WO | 9529697 A1 | 11/1995 |
| WO | 95/35375 A1 | 12/1995 |
| WO | 9533835 | 12/1995 |
| WO | 9617086 | 6/1996 |
| WO | 9711085 | 3/1997 |
| WO | 9712519 | 4/1997 |
| WO | 9730064 A1 | 8/1997 |
| WO | 9741210 | 11/1997 |
| WO | 9746680 | 12/1997 |
| WO | 9748370 | 12/1997 |
| WO | 9800547 | 1/1998 |
| WO | 9812207 | 3/1998 |
| WO | 9819710 A2 | 5/1998 |
| WO | 9834640 | 8/1998 |
| WO | 9847913 A2 | 10/1998 |
| WO | 9855495 | 12/1998 |
| WO | 99/06073 | 2/1999 |
| WO | 9914346 | 3/1999 |
| WO | 9920766 | 4/1999 |
| WO | 9920774 | 4/1999 |
| WO | 9933982 | 7/1999 |
| WO | 9942618 | 8/1999 |
| WO | 9943835 | 9/1999 |
| WO | 9952503 | 10/1999 |
| WO | 9954457 | 10/1999 |
| WO | 0026226 | 5/2000 |
| WO | 0027340 | 5/2000 |
| WO | 0029561 | 5/2000 |
| WO | 0039327 | 7/2000 |
| WO | 0050586 | 8/2000 |
| WO | 0075304 | 12/2000 |
| WO | 0075356 | 12/2000 |
| WO | 0100650 | 1/2001 |
| WO | 0104313 | 1/2001 |
| WO | 01/14424 A2 | 3/2001 |
| WO | 0121810 | 3/2001 |
| WO | 0155306 | 8/2001 |
| WO | 01/78779 A2 | 10/2001 |
| WO | 0192523 | 12/2001 |
| WO | 0193902 | 12/2001 |
| WO | 0208435 | 1/2002 |
| WO | 0224873 | 3/2002 |
| WO | 0246477 | 6/2002 |
| WO | 02064799 | 8/2002 |
| WO | 02065093 | 8/2002 |
| WO | 02102839 | 12/2002 |
| WO | 03002604 | 1/2003 |
| WO | 03018798 | 3/2003 |
| WO | 03028656 | 4/2003 |
| WO | 03029401 | 4/2003 |
| WO | 03046578 | 6/2003 |
| WO | 03050258 | 6/2003 |
| WO | 03051923 | 6/2003 |
| WO | 03059194 | 7/2003 |
| WO | 03059381 | 7/2003 |
| WO | 03066649 | 8/2003 |
| WO | 03086280 | 10/2003 |
| WO | 03087815 | 10/2003 |
| WO | 03101401 | 12/2003 |
| WO | 2004005544 | 1/2004 |
| WO | 2004010106 | 1/2004 |
| WO | 2004035607 A2 | 4/2004 |
| WO | 2004037972 | 5/2004 |
| WO | 2004058159 | 7/2004 |
| WO | 2004065561 | 8/2004 |
| WO | 2004067728 | 8/2004 |
| WO | 2004085474 | 10/2004 |
| WO | 2004087868 | 10/2004 |
| WO | 2004092329 | 10/2004 |
| WO | 2005005622 | 1/2005 |
| WO | 2005009346 | 2/2005 |
| WO | 2005017107 A2 | 2/2005 |
| WO | 2005/044859 A2 | 5/2005 |
| WO | 2005040416 | 5/2005 |
| WO | 2005047536 | 5/2005 |
| WO | 2005/062967 A2 | 7/2005 |
| WO | 2005098433 | 10/2005 |
| WO | 2005103081 A2 | 11/2005 |
| WO | 2005117557 | 12/2005 |
| WO | 2005118857 | 12/2005 |
| WO | 2006008154 A1 | 1/2006 |
| WO | 2006/013107 A1 | 2/2006 |
| WO | 2006022712 | 3/2006 |
| WO | 2006044456 | 4/2006 |
| WO | 2006044503 | 4/2006 |
| WO | 2006044505 | 4/2006 |
| WO | 2006044682 | 4/2006 |
| WO | 2006046978 A2 | 5/2006 |
| WO | 2006058088 | 6/2006 |
| WO | 2006063249 | 6/2006 |
| WO | 2006065479 | 6/2006 |

(56) References Cited

FOREIGN PATENT DOCUMENTS

| | | |
|---|---|---|
| WO | 2006065480 | 6/2006 |
| WO | 2006071903 | 7/2006 |
| WO | 2006095259 | 9/2006 |
| WO | 2006110581 | 10/2006 |
| WO | 2006110585 | 10/2006 |
| WO | 2006110599 | 10/2006 |
| WO | 2007005645 | 1/2007 |
| WO | 2007024323 | 3/2007 |
| WO | 2007024708 | 3/2007 |
| WO | 2007064952 | 3/2007 |
| WO | 2007059782 A1 | 5/2007 |
| WO | 2007062495 | 6/2007 |
| WO | 2007067968 | 6/2007 |
| WO | 2007069068 A2 | 6/2007 |
| WO | 2007095976 A2 | 8/2007 |
| WO | 2007100699 | 9/2007 |
| WO | 2007100789 | 9/2007 |
| WO | 2007104537 | 9/2007 |
| WO | 2008/003319 A1 | 1/2008 |
| WO | 2008011519 | 1/2008 |
| WO | 2008/019371 A | 2/2008 |
| WO | 2008014979 | 2/2008 |
| WO | 2008014979 A2 | 2/2008 |
| WO | 2008022046 A2 | 2/2008 |
| WO | 2008042973 | 4/2008 |
| WO | 2008051245 | 5/2008 |
| WO | 2008052770 | 5/2008 |
| WO | 2008068631 | 6/2008 |
| WO | 2008078180 | 7/2008 |
| WO | 2008078180 A2 | 7/2008 |
| WO | 2008083949 | 7/2008 |
| WO | 2008083949 A2 | 7/2008 |
| WO | 2008091799 | 7/2008 |
| WO | 2008/096370 A2 | 8/2008 |
| WO | 2008107388 A1 | 9/2008 |
| WO | 2008115504 A2 | 9/2008 |
| WO | 2008/134724 A2 | 11/2008 |
| WO | 2008/143878 A2 | 11/2008 |
| WO | 2008140615 | 11/2008 |
| WO | 2008144365 | 11/2008 |
| WO | 2008151049 A2 | 12/2008 |
| WO | 2008151058 | 12/2008 |
| WO | 2008153705 | 12/2008 |
| WO | 2008157688 | 12/2008 |
| WO | 2009006438 | 1/2009 |
| WO | 2009015071 | 1/2009 |
| WO | 2009024599 | 2/2009 |
| WO | 2009030254 | 3/2009 |
| WO | 2009030254 A1 | 3/2009 |
| WO | 2009030481 | 3/2009 |
| WO | 2009042971 | 4/2009 |
| WO | 2009046738 | 4/2009 |
| WO | 2009046739 | 4/2009 |
| WO | 2009046974 | 4/2009 |
| WO | 2009046975 | 4/2009 |
| WO | 2009/068649 A2 | 6/2009 |
| WO | 2009077134 | 6/2009 |
| WO | 2009095226 | 8/2009 |
| WO | 2009101407 | 8/2009 |
| WO | 2009/113083 A1 | 9/2009 |
| WO | 2009/120927 A2 | 10/2009 |
| WO | 2009127060 | 10/2009 |
| WO | 2009127230 | 10/2009 |
| WO | 2009149253 | 12/2009 |
| WO | 2010009065 | 1/2010 |
| WO | 2010009277 | 1/2010 |
| WO | 2010027903 | 3/2010 |
| WO | 2010033906 | 3/2010 |
| WO | 2010037408 | 4/2010 |
| WO | 2010037408 A1 | 4/2010 |
| WO | 2010037539 | 4/2010 |
| WO | 2010042490 | 4/2010 |
| WO | 2010042877 | 4/2010 |
| WO | 2010054406 | 5/2010 |
| WO | 2010/068918 A2 | 6/2010 |
| WO | 2010084371 A1 | 7/2010 |
| WO | 2010088537 | 8/2010 |
| WO | 2010088927 | 8/2010 |
| WO | 2010098861 | 9/2010 |
| WO | 2010111290 | 9/2010 |
| WO | 2010120266 | 10/2010 |
| WO | 2010129709 | 11/2010 |
| WO | 2010141135 | 12/2010 |
| WO | 2010141135 A2 | 12/2010 |
| WO | 2010144740 | 12/2010 |
| WO | 2011/005799 A2 | 1/2011 |
| WO | 2011005341 A3 | 1/2011 |
| WO | 2011005799 | 1/2011 |
| WO | 2011/032633 A1 | 3/2011 |
| WO | 2011026641 | 3/2011 |
| WO | 2011026641 A9 | 3/2011 |
| WO | 2011062965 | 5/2011 |
| WO | 2011/069164 A2 | 6/2011 |
| WO | 2011068810 | 6/2011 |
| WO | 2011069528 | 6/2011 |
| WO | 2011069529 | 6/2011 |
| WO | 2011069586 | 6/2011 |
| WO | 2011069587 | 6/2011 |
| WO | 2011071931 | 6/2011 |
| WO | 2011071936 | 6/2011 |
| WO | 2011076807 | 6/2011 |
| WO | 2011025566 | 7/2011 |
| WO | 2011088309 | 7/2011 |
| WO | 2011120053 | 9/2011 |
| WO | 2011127032 A1 | 10/2011 |
| WO | 2011127255 | 10/2011 |
| WO | 2011127933 A1 | 10/2011 |
| WO | 2011128444 | 10/2011 |
| WO | 2011130624 | 10/2011 |
| WO | 2011133868 A2 | 10/2011 |
| WO | 2011137206 | 11/2011 |
| WO | 2011144358 | 11/2011 |
| WO | 2011161653 | 12/2011 |
| WO | 2012003474 A2 | 1/2012 |
| WO | 2012006359 | 1/2012 |
| WO | 2012006369 | 1/2012 |
| WO | 2012006372 | 1/2012 |
| WO | 2012006376 | 1/2012 |
| WO | 2012006377 | 1/2012 |
| WO | 2012006378 | 1/2012 |
| WO | 2012006380 | 1/2012 |
| WO | 2012010855 | 1/2012 |
| WO | 2012013326 | 2/2012 |
| WO | 2012019168 | 2/2012 |
| WO | 2012019630 | 2/2012 |
| WO | 2012019780 | 2/2012 |
| WO | 2012023044 | 2/2012 |
| WO | 2012024526 | 2/2012 |
| WO | 2012030683 | 3/2012 |
| WO | 2012030901 | 3/2012 |
| WO | 2012030904 A2 | 3/2012 |
| WO | 2012031043 | 3/2012 |
| WO | 2012031046 | 3/2012 |
| WO | 2012034067 A1 | 3/2012 |
| WO | 2012034077 A2 | 3/2012 |
| WO | 2012045075 | 4/2012 |
| WO | 2012045082 | 4/2012 |
| WO | 2012050975 A2 | 4/2012 |
| WO | 2012064429 | 5/2012 |
| WO | 2012065164 | 5/2012 |
| WO | 2012068295 | 5/2012 |
| WO | 2012068360 | 5/2012 |
| WO | 2012068470 | 5/2012 |
| WO | 2012072269 | 6/2012 |
| WO | 2012075040 | 6/2012 |
| WO | 2012088381 | 6/2012 |
| WO | 2012089225 | 7/2012 |
| WO | 2012089338 | 7/2012 |
| WO | 2012094304 | 7/2012 |
| WO | 2012094574 | 7/2012 |
| WO | 2012099755 | 7/2012 |
| WO | 2012099805 | 7/2012 |
| WO | 2012103985 | 8/2012 |
| WO | 2012110636 A2 | 8/2012 |

(56) References Cited

FOREIGN PATENT DOCUMENTS

| | | |
|---|---|---|
| WO | 2012112582 | 8/2012 |
| WO | 2012113413 | 8/2012 |
| WO | 2012113513 | 8/2012 |
| WO | 2012116714 | 9/2012 |
| WO | 2012116715 | 9/2012 |
| WO | 2012116810 | 9/2012 |
| WO | 2012116811 | 9/2012 |
| WO | 2012117377 | 9/2012 |
| WO | 2012122318 | 9/2012 |
| WO | 2012125680 | 9/2012 |
| WO | 2012125812 | 9/2012 |
| WO | 2012125987 | 9/2012 |
| WO | 2012129483 | 9/2012 |
| WO | 2012131594 | 10/2012 |
| WO | 2012135025 | 10/2012 |
| WO | 2012135805 | 10/2012 |
| WO | 2012135805 A2 | 10/2012 |
| WO | 2012138453 A1 | 10/2012 |
| WO | 2012138530 A1 | 10/2012 |
| WO | 2012142240 | 10/2012 |
| WO | 2012143407 | 10/2012 |
| WO | 2012/149045 A2 | 11/2012 |
| WO | 2012/149252 A2 | 11/2012 |
| WO | 2012/149255 A2 | 11/2012 |
| WO | 2012/149259 A1 | 11/2012 |
| WO | 2012/149265 A2 | 11/2012 |
| WO | 2012/149282 A2 | 11/2012 |
| WO | 2012/149301 A2 | 11/2012 |
| WO | 2012/149376 A2 | 11/2012 |
| WO | 2012/149393 A2 | 11/2012 |
| WO | 2012/152910 A1 | 11/2012 |
| WO | 2012/153297 A1 | 11/2012 |
| WO | 2012/153338 A2 | 11/2012 |
| WO | 2012149246 | 11/2012 |
| WO | 2012149536 A1 | 11/2012 |
| WO | 2012151234 | 11/2012 |
| WO | 2012154202 A1 | 11/2012 |
| WO | 2012158613 | 11/2012 |
| WO | 2012160177 | 11/2012 |
| WO | 2012/162174 A1 | 12/2012 |
| WO | 2012166241 | 12/2012 |
| WO | 2012166923 | 12/2012 |
| WO | 2012168259 | 12/2012 |
| WO | 2012168491 | 12/2012 |
| WO | 2012170607 | 12/2012 |
| WO | 2012170889 | 12/2012 |
| WO | 2012170930 | 12/2012 |
| WO | 2012172495 | 12/2012 |
| WO | 2012172521 | 12/2012 |
| WO | 2012177760 A1 | 12/2012 |
| WO | 2013/003887 A1 | 1/2013 |
| WO | 2013/006824 A2 | 1/2013 |
| WO | 2013003475 | 1/2013 |
| WO | 2013006437 | 1/2013 |
| WO | 2013006825 | 1/2013 |
| WO | 2013006834 | 1/2013 |
| WO | 2013006837 | 1/2013 |
| WO | 2013006838 | 1/2013 |
| WO | 2013006842 | 1/2013 |
| WO | 2013009717 | 1/2013 |
| WO | 2013009736 | 1/2013 |
| WO | 2013011325 | 1/2013 |
| WO | 2013012476 | 1/2013 |
| WO | 2013016460 | 1/2013 |
| WO | 2013019669 | 2/2013 |
| WO | 2013025834 A2 | 2/2013 |
| WO | 2013030778 | 3/2013 |
| WO | 2013032829 | 3/2013 |
| WO | 2013033438 | 3/2013 |
| WO | 2013033563 | 3/2013 |
| WO | 2013033620 | 3/2013 |
| WO | 2013038375 | 3/2013 |
| WO | 2013039857 | 3/2013 |
| WO | 2013039861 | 3/2013 |
| WO | 2013044219 | 3/2013 |
| WO | 2013045505 | 4/2013 |
| WO | 2013049234 | 4/2013 |
| WO | 2013049247 | 4/2013 |
| WO | 2013049328 | 4/2013 |
| WO | 2013052167 | 4/2013 |
| WO | 2013052523 | 4/2013 |
| WO | 2013054307 | 4/2013 |
| WO | 2013055331 | 4/2013 |
| WO | 2013055905 | 4/2013 |
| WO | 2013055971 | 4/2013 |
| WO | 2013056132 | 4/2013 |
| WO | 2013057687 | 4/2013 |
| WO | 2013057715 | 4/2013 |
| WO | 2013059496 | 4/2013 |
| WO | 2013059509 | 4/2013 |
| WO | 2013/066866 A1 | 5/2013 |
| WO | 2013059922 | 5/2013 |
| WO | 2013061208 | 5/2013 |
| WO | 2013062140 | 5/2013 |
| WO | 2013063468 | 5/2013 |
| WO | 2013063530 | 5/2013 |
| WO | 2013064911 | 5/2013 |
| WO | 2013066274 | 5/2013 |
| WO | 2013066427 | 5/2013 |
| WO | 2013066903 | 5/2013 |
| WO | 2013067355 | 5/2013 |
| WO | 2013067530 | 5/2013 |
| WO | 2013067537 | 5/2013 |
| WO | 2013068413 | 5/2013 |
| WO | 2013068431 | 5/2013 |
| WO | 2013068432 | 5/2013 |
| WO | 2013068847 | 5/2013 |
| WO | 2013070653 | 5/2013 |
| WO | 2013070872 | 5/2013 |
| WO | 2013071047 | 5/2013 |
| WO | 2013072392 | 5/2013 |
| WO | 2013072929 | 5/2013 |
| WO | 2013074696 | 5/2013 |
| WO | 2013075068 | 5/2013 |
| WO | 2013077907 | 5/2013 |
| WO | 2013078199 | 5/2013 |
| WO | 2013/087911 A1 | 6/2013 |
| WO | 2013079604 | 6/2013 |
| WO | 2013082111 | 6/2013 |
| WO | 2013082418 | 6/2013 |
| WO | 2013082427 | 6/2013 |
| WO | 2013082470 | 6/2013 |
| WO | 2013082529 | 6/2013 |
| WO | 2013082590 | 6/2013 |
| WO | 2013084000 | 6/2013 |
| WO | 2013085951 | 6/2013 |
| WO | 2013086008 | 6/2013 |
| WO | 2013086322 | 6/2013 |
| WO | 2013086354 | 6/2013 |
| WO | 2013086373 | 6/2013 |
| WO | 2013086486 | 6/2013 |
| WO | 2013086502 | 6/2013 |
| WO | 2013086505 | 6/2013 |
| WO | 2013086526 | 6/2013 |
| WO | 2013087083 | 6/2013 |
| WO | 2013087791 | 6/2013 |
| WO | 2013087912 A1 | 6/2013 |
| WO | 2013088250 | 6/2013 |
| WO | 2013090294 | 6/2013 |
| WO | 2013090601 | 6/2013 |
| WO | 2013090648 | 6/2013 |
| WO | 2013090841 | 6/2013 |
| WO | 2013090897 | 6/2013 |
| WO | 2013090961 | 6/2013 |
| WO | 2013091001 | 6/2013 |
| WO | 2013093648 | 6/2013 |
| WO | 2013096626 | 6/2013 |
| WO | 2013096812 A1 | 6/2013 |
| WO | 2013098589 | 7/2013 |
| WO | 2013103842 | 7/2013 |
| WO | WO 2013/103659 A1 | 7/2013 |
| WO | WO 2013/109713 A1 | 7/2013 |
| WO | 2013112778 | 8/2013 |
| WO | 2013112780 | 8/2013 |

(56) References Cited

FOREIGN PATENT DOCUMENTS

| | | |
|---|---|---|
| WO | 2013113326 | 8/2013 |
| WO | 2013113501 | 8/2013 |
| WO | 2013113502 | 8/2013 |
| WO | 2013113736 | 8/2013 |
| WO | WO 2013/120497 A1 | 8/2013 |
| WO | WO 2013/120498 A1 | 8/2013 |
| WO | WO 2013/120499 A1 | 8/2013 |
| WO | WO 2013/120500 A1 | 8/2013 |
| WO | WO 2013/120626 A1 | 8/2013 |
| WO | WO 2013/120627 A1 | 8/2013 |
| WO | WO 2013/120628 A1 | 8/2013 |
| WO | WO 2013/120629 A1 | 8/2013 |
| WO | 2013128027 | 9/2013 |
| WO | 2013130161 | 9/2013 |
| WO | 2013130535 | 9/2013 |
| WO | 2013135359 | 9/2013 |
| WO | 2013136234 | 9/2013 |
| WO | 2013138343 | 9/2013 |
| WO | 2013138346 | 9/2013 |
| WO | 2013142349 A1 | 9/2013 |
| WO | 2013143555 | 10/2013 |
| WO | 2013143683 | 10/2013 |
| WO | 2013143698 | 10/2013 |
| WO | 2013143699 | 10/2013 |
| WO | 2013143700 | 10/2013 |
| WO | 2013148186 | 10/2013 |
| WO | 2013148541 | 10/2013 |
| WO | 2013149141 | 10/2013 |
| WO | 2013151650 | 10/2013 |
| WO | 2013151669 | 10/2013 |
| WO | 2013151672 | 10/2013 |
| WO | 2013151771 | 10/2013 |
| WO | 2013152351 | 10/2013 |
| WO | 2013153550 | 10/2013 |
| WO | 2013154766 | 10/2013 |
| WO | 2013154774 | 10/2013 |
| WO | 2013155487 | 10/2013 |
| WO | 2013155493 | 10/2013 |
| WO | 2013155513 | 10/2013 |
| WO | 2013158127 | 10/2013 |
| WO | 2013158141 | 10/2013 |
| WO | 2013158579 | 10/2013 |
| WO | 2013/177421 A2 | 11/2013 |
| WO | 2013166385 | 11/2013 |
| WO | 2013166498 | 11/2013 |
| WO | 2013173582 A1 | 11/2013 |
| WO | 2013173657 | 11/2013 |
| WO | 2013173693 | 11/2013 |
| WO | 2013174409 | 11/2013 |
| WO | 2013182683 | 12/2013 |
| WO | 2013184945 | 12/2013 |
| WO | 2013185069 | 12/2013 |
| WO | 2013188979 | 12/2013 |
| WO | 2014004436 A2 | 1/2014 |
| WO | 2014012479 A1 | 1/2014 |
| WO | 2014012994 | 1/2014 |
| WO | 2014012996 | 1/2014 |
| WO | 2014014613 | 1/2014 |
| WO | 2014014890 A1 | 1/2014 |
| WO | 2014015334 | 1/2014 |
| WO | 2014015422 | 1/2014 |
| WO | 2014016439 | 1/2014 |
| WO | 2014018675 | 1/2014 |
| WO | 2014024193 | 2/2014 |
| WO | 2014025312 | 2/2014 |
| WO | 2014025795 | 2/2014 |
| WO | 2014025890 | 2/2014 |
| WO | 2014026044 | 2/2014 |
| WO | 2014026284 | 2/2014 |
| WO | 2014027006 | 2/2014 |
| WO | 2014028209 | 2/2014 |
| WO | 2014028487 | 2/2014 |
| WO | 2014028763 | 2/2014 |
| WO | 2014/039185 A1 | 3/2014 |
| WO | 2014/042920 A1 | 3/2014 |
| WO | 2014/043618 A1 | 3/2014 |
| WO | 2014/047649 A1 | 3/2014 |
| WO | 2014/052634 A1 | 4/2014 |
| WO | 2014/053654 A1 | 4/2014 |
| WO | 2014/054026 A1 | 4/2014 |
| WO | 2014/059022 A1 | 4/2014 |
| WO | 2014053622 A1 | 4/2014 |
| WO | 2014053624 A1 | 4/2014 |
| WO | 2014053628 A1 | 4/2014 |
| WO | 2014053629 A1 | 4/2014 |
| WO | 2014053634 A1 | 4/2014 |
| WO | 2014053879 A1 | 4/2014 |
| WO | 2014053880 A1 | 4/2014 |
| WO | 2014053881 A1 | 4/2014 |
| WO | 2014053882 A1 | 4/2014 |
| WO | 2014062697 A2 | 4/2014 |
| WO | 2014063059 A1 | 4/2014 |
| WO | 2014/064534 A2 | 5/2014 |
| WO | 2014/064543 A1 | 5/2014 |
| WO | 2014/066811 A1 | 5/2014 |
| WO | 2014/066898 A9 | 5/2014 |
| WO | 2014/066912 A1 | 5/2014 |
| WO | 2014/071072 A2 | 5/2014 |
| WO | 2014/072468 A1 | 5/2014 |
| WO | 2014/072747 A1 | 5/2014 |
| WO | 2014/072997 A1 | 5/2014 |
| WO | 2014/072999 A1 | 5/2014 |
| WO | 2014/074218 A1 | 5/2014 |
| WO | 2014/074299 A1 | 5/2014 |
| WO | 2014/074597 A1 | 5/2014 |
| WO | 2014064258 A1 | 5/2014 |
| WO | 2014064687 A1 | 5/2014 |
| WO | 2014067551 A1 | 5/2014 |
| WO | 2014068542 A1 | 5/2014 |
| WO | 2014071219 A1 | 5/2014 |
| WO | 2014071963 A1 | 5/2014 |
| WO | 2014072061 A1 | 5/2014 |
| WO | 2014072481 A1 | 5/2014 |
| WO | 2014074289 A1 | 5/2014 |
| WO | 2014074823 A1 | 5/2014 |
| WO | 2014074905 A1 | 5/2014 |
| WO | 2014074912 A1 | 5/2014 |
| WO | 2014075047 A2 | 5/2014 |
| WO | 2014076709 A1 | 5/2014 |
| WO | 2014078399 A1 | 5/2014 |
| WO | 2014078636 A1 | 5/2014 |
| WO | 2014081299 A1 | 5/2014 |
| WO | 2014081300 A1 | 5/2014 |
| WO | 2014081303 A1 | 5/2014 |
| WO | 2014081507 A1 | 5/2014 |
| WO | 2014081849 A1 | 5/2014 |

OTHER PUBLICATIONS

Ellem, K.A.O., and Colter, J.S. The isolation of three variants of merigo virus differing in plaque morphology and hemagglutinating characteristics. Virology. Nov. 1961; 15(3): 340-347.

Ellem, K.A.O., and Colter, J.S. The interaction of infectious ribonucleic acid with a mammalian cell line: I. Relationship between the osmotic pressure of the medium and the production of infectious centers. Virology. Jun. 1960; 11(2): 434-443.

Ellem, K.A.O. and Colter, J.S. The interaction of infectious ribonucleic acid with a mammalian cell line: II. Kinetics of the formation of infectious centers. Virology, Dec. 1960: 12(4): 511-520.

Ellen K.A.O and Colter, J.S. The interaction of infectious ribonucleic acids with mammalian cells: III. Comparison of infection and RNA uptake in the HeLa cell-polio RNA and L cell-rnengo RNA systems. Virology. Oct. 1961; 15(2): 113-126.

Epicentre Forum. Tools and Techniques for Genomics and RNA Research. 2006; 13(2): 1-3.

Epicentre Forum. Tools and Techniques for Genomics and RNA Research. 2007; 14(1): 1-24.

Esposito, S., Effect on Leukaemic Cells of Ribonucleic Acid Extracted from Calf's Spleen. Nature. Sep. 1964; 203: 1078-1079.

Esvelt, K., et al., A system for the continuous directed evolution of biomolecules. Nature. Apr. 2011; 472(7344): 499-503.

(56) References Cited

OTHER PUBLICATIONS

Fahy, E. et al., Self-sustained sequence replication (3SR): an isothermal transcription-based amplification system alternative to PCR. PCR Methods Appl. Aug. 1, 1991(1):25-33.

Faissner, A. et al., Analysis of polypeptides of the tree shrew (Tupaia) herpesvirus by gel electrophoresis. J Gen Virol. Jan. 1982;58 Pt 1:139-48.

Fan, X.C., et al., Overexpression of HuR, a nuclear-cytoplasmic shuttling protein, increases the in vivo stability of ARE-containing mRNAs. Embo J 1998; 17(12): 3448-3460.

Fandrich, F. et al., Preimplantation-stage stem cells induce long term allogeneic graft acceptance without supplementary host conditioning. Nat Med. Feb. 2002;8(2):171-8.

Fang, S.H. et al., Functional measurement of hepatitis C virus core-specific CD8(+) T-cell responses in the livers or peripheral blood of patients by using autologous peripheral blood mononuclear cells as targets or stimulators. J Clin. Microbiol. Nov. 2001;39(11):3895-901.

Fearnley, D.B. et al., Monitoring human blood dendritic cell numbers in normal individuals and in stem cell transplantation. Blood. Jan. 15, 1999;93(2):728-36.

Felgner, P.L., et al., Lipofection: a highly efficient, lipid-mediated DNA-transfection procedure Proc Natl Acad Sci U S A. Nov. 1987;84(21):7413-7.

Felgner, P.L. Particulate systems and polymers for in vitro and in vivo delivery of polynucleotides. Adv. Drug Delivery Rev. 1990; 5(3): 163-187.

Felgner, P.L. Cationic lipid/polynucleotide condensates for in vitro and in vivo polynucleotide delivery—the cylofectins. J. of Liposome Research. 1993; 3(1): 3-16.

Fisch, P. et al., Generation of antigen-presenting cells for soluble protein antigens ex vivo from peripheral blood CD34+ hematopoietic progenitor cells in cancer patients, Eur J Immunol. Mar. 1996;26(3):595-600.

Fisher, K.J. and Wilson, J.M. The transmembrane domain of diphtheria toxin improves molecular conjugate gene transfer. Biochem. J. Jan. 1997; 321(1): 49-58.

Fishman, M., et al., In vitro transfer of macrophage RNA to lymph node cells. Nature. May 11, 1963;198:549-51.

Fisk, B. et al., Identification of an immunodominant peptide, of HER-2/neu protooncoclene recognized by ovarian tumor-specific cytotoxic T lymphocyte lines. J Exp Med. Jun. 1, 1995;181(6):2109-17.

Frank, B. et al., Interanimal "memory" transfer: results from brain and liver homogenates. Science. Jul. 24, 1970;169(3943):399-402.

Franklin, R.M., Purification and properties of the replicative intermediate of the RNA bacteriophage R17. Proc Natl Acad Sci U S A. Jun. 1966;55(6):1504-11.

Frey, M.R. et al., RNA-mediated interaction of Cajal bodies and U2 snRNA genes. J Cell Biol. Aug. 6, 2011;154(3):499-509.

Fukuda, N., et al., In vitro evolution of single-chain antibodies using mRNA display. Nucleic Acids Res. 2006;34(19): e127. Epub Sep. 29, 2006.

Fusaki, N., et al., Efficient induction of transgene-free human pluyripotent stem cells using a vector based on Sendai virus, an RNA virus that does not integrate into the host genome. Proc Jpn Acad Ser B Phys Biol Sci. 2009; 85(8): 348-362.

Fynan E.F. et al., DNA vaccines: protective immunizations by parenteral, mucosal, and gene-gun inoculations. Proc Natl Acad Sci U S A. Dec. 15, 1993;90(24):11478-82.

Gall, J.G. et al., A role for Cajal bodies in assembly of the nuclear transcription machinery. FEBS Lett. Jun. 8, 2001;8;498(2-3):164-7.

Gall, J.G. The centennial of the Cajal body. Nat Rev mol Cell Biol. Dec. 2003;4(12):975-80.

Gallie, D.R. A tale of two termini: a functional interaction between the termini of an mRNA is a prerequisite for efficient translation initiation. Gene. Aug. 17, 1998;216(1):1-11.

Gallie, D.R. The cap and poly(A) tail function synergistically to regulate mRNA translational efficiency. Genes Dev. Nov. 1991;5(11):2108-16.

Ganot, P. et al., Site-specific pseudouridine formation in preribosomal RNA is guided by small nucleolar RNAs. Cell. May 30, 1997;89(5):799-809.

Gao, M. et al., A novel mRNA-decapping activity in HeLa cytoplasmic extracts is regulated by AU-rich elements. EMBO J. Mar. 1, 2001;20(5):1134-43.

Gao, X. et al., Nonviral gene delivery, what we know and what is next. AAPS J. Mar. 23, 2007;9(1):E92-104.

Garbe, C. et al., [Epidemiology of malignant melanoma in West Germany in an international comparison]. Onkologie. Dec. 1989;12(6):253-62.

Gardiner-Garden, M. et al., CpG islands in vertebrate genomes. J Mol Biol. Jul. 20, 1987;196(2):261-82.

Gasche, C. et al., Sequential treatment of anemia in ulcerative colitis with intravenous iron and erythropoietin. Digestion. 1999;60(3):262-7.

GenBank NP_000651.3. Transforming growth factor beta-1 precursor [*Homo sapiens*]. Nov. 13, 2001; online.

Gerbi, S.A. et al., All small nuclear RNAs (snRNAs) of the [U4/U6,U5] Tri-snRNP localize to nucleoli; Identification of the nucleolar localization element of U6 snRNA. Mol Biol Cell. Sep. 2002;13(9):3123-37.

Gershon, P.D., (A)-tail of two polymerase structures. Nat Struct Biol. Oct. 2000;7(10):819-21.

Gierer, A and Schramm, G. Infectivity of ribonucleic acid from tobacco mosaic virus. Nature. Apr. 1956; 177(4511):702-703.

Gilboa, E. et al., Cancer immunotherapy with mRNA-transfected dendritic cells. Immunol Rev. Jun. 2004;199:251-63.

Giljohann, D.A., et al., Gene regulation with polyvalent siRNA-nanoparticle conjugates. J Am Chem Soc. Feb. 2009;131(6): 2072-2073.

Gilkeson, G.S. et al., Induction of cross-reactive anti-dsDNA antibodies in preautoimmune NZB/NZW mice by immunization with bacterial DNA. J Clin Invest. Mar. 1995;95(3):1398-402.

Ginsberg, S.D. et al., Expression profile of transcripts in Alzheimer's disease tangle-bearing CA1 neurons. Ann Neurol. Jul. 2000;48(1):77-87.

Ginsberg, S.D. et al., Predominance of neuronal mRNAs in individual Alzheimer's disease senile plaques. Ann Neurol. Feb. 1999;45(2):174-81.

Hoerr, I. et al., In vivo application of RNA ads to induction of specific cytotoxic T lymphocytes and antibodies. Eur J Immunol. Jan. 2000:30(1):1-7.

Hoerr, I. et al., Stabilized Messenger RNA (RNActiveTM) as a Tool for Innovative Gene Delivery. Tissue Engineering. Apr. 2007; 13(4): 865-925.

Holcik, M. et al., Four highly stable eukaryotic mRNAs assemble 3'untranslated region RNA-protein complexes sharing cis and trans components. oc Natl Acad Sci U S A. Mar. 18, 1997;94(6):2410-4.

Holmes, D. et al., Cell positioning and sorting using dielectrophoresis. Eur Cell Mater. 2002; 4(2):120-2.

Holtkamp, S. et al., Modification of antigen-encoding RNA increases stability, translational efficacy, and T-cell stimulatory capacity of dendritic cells. Blood. Dec. 15, 2006;108(13):4009-17.

Houghton, A.N. et al., Cancer antigens: immune recognition of self and altered self. J Exp Med. Jul. 1, 1994;180(1):1-4.

Hsu, F.J. et al., Vaccination of patients with B-cell lymphoma using autologous antigen-pulsed dendritic cells. Nat Med. Jan. 1996;2(1):52-8.

Hu, B., et al., Neural differentation of human induced pluripotent stem cells follows developmental principles but with variable potency. Natl Acad Sci. Mar. 2010; 107(9): 4335-4340.

Hu, S. et al., Codon optimization, expression, and characterization of an internalizing anti-ErbB2 single-chain antibody in Pichia pastoris. Protein Expr. Purif. May 2006;47(1):249-57. Epub Dec. 13, 2005.

Huangfu, D., et al., Induction of pluripotent stem cells by defined factors is greatly improved by small-molecule compounds. Nat Biotech. Jul. 2008; 26(7) 795-797.

Huddleston, J.A. et al., The sequence of the nucleoprotein gene of human influenza A virus, strain A/NT/60/68. Nucleic Acids Res. Feb. 11, 1982;10(3):1029-38.

(56) References Cited

OTHER PUBLICATIONS

Hue, K.K. et al., A polypurine sequence that acts as a 5' mRNA stabilizer in Bacillus subtilis. J Bacteriol. Jun. 1995;177 (12):3465-71.
Hung, C.F. et al., Ovarian cancer gene therapy using HPV-16 pseudovirion carrying the HSV-tk gene. PLoS ONE. Jul. 2012; 7(7):e40983.
Inaba, K. et al., Dendritic cells pulsed with protein antigens in vitro can prime antigen-specific, MHC-restricted T cells in situ. J Exp Med. Aug. 1, 1990;172(2):631-40.
Inaba, K. et al., Direct activation of CD8+ cytotoxic T lymphocytes by dendritic cells. J Exp Med. Jul. 1, 1987;166(1):182-94.
Inaba, K. et al., Generation of large numbers of dendritic cells from mouse bone marrow cultures supplemented with granulocyte/macrophage colony-stimulating factor, J Exp Med. Dec. 1, 1992;176(6):1693-702.
International Search Report from International Application No. PCT/US11/54617 dated Oct. 3, 2011.
International Search Report from International Application No. PCT/US11/54617 dated Feb. 1, 2012.
International Search Report from International Application No. PCT/US2012/031781 dated Jan. 11, 2013.
International Search Report from International Application No. PCT/US12/38028 dated Aug. 14, 2012.
International Search Report from International Application No. PCT/US12/54561 dated Feb. 26, 2013.
International Search Report from International Application No. PCT/US12/58519 dated Feb. 28, 2013.
International Search Report from International Application No PCT/US12/68732 dated Feb. 22, 2013.
International Search Report from International Application No. PCT/US12/69610 dated Feb. 27, 2013.
International Search Report from International Application No. PCT/US12/71105 dated Mar. 5, 2013.
International Search Report from International Application No. PCT/US13/20921 dated Mar. 26, 2013.
International Search Report from International Application No. PCT/US12/71118 dated Apr. 5, 2013.
Ito, M.K., ISIS 301012 gene therapy for hypercholesterolemia: sense, antisense, or nonsense? Ann Pharmacother. Oct. 2007; 41(10): 1669-78.
Ivanovska, N. et al. Immunization with a DNA chimeric molecule encoding a hemagglutinin peptide and scFv CD21-specific antiobdy fragment induces long-lasting IgM and CTL responses to influenza virus. Vaccine. Mar. 10, 2006;24(11):1830-7. Epub Nov. 2, 2005.
Iwasaki, A. et al., Enhanced CTL responses mediated by plasmid DNA immunogens encoding costimulatory molecules and cytokines. J. Immunol. May 15, 1997;158(1):4591-601.
Jady, B.E. et al., A small nucleolar guide RNA functions both in 2'-O-ribose methylation and pseudouridylation of the U5 spliceosomal RNA. EMBO J. Feb. 1, 2001;20(3):541-51.
Janeway, C. et al., Immunobiology: the immune system in health and disease. Garland Publishing, Inc, London. 1997; 13:12-13:21.
Jansen, P.L.M., Diagnosis and management of Crigler-Najjar syndrome. Eur J Pediatr. Dec. 1999;158 [Suppl 2]:S89-S94.
Janssens, S. et al., Role of Toll-like receptors in pathogen recognition. Clin Microbiol Rev. Oct. 2003;16(4):637-46.
Jemielity, J. et al., Novel "anti-reverse" cap analogs with superior translational properties. RNA. Sep. 2003;9(9):1108-22.
Jia, F., et al., A nonviral minicircle vector for deriviing human iPS Cells. Nat Methods. Mar. 2010; 7(3): 197-199.
Jia, Z., et al., Long-term correction of hyperbilirubinemia in the Gunn Rat by repeated intravenous delivery of naked plasmid DNA into muscle. Mol Ther. Nov. 2005; 12(5): 860-866.
Jiang, J. et al., Topical application of ketoconazole stimulates hair growth in C3H/HeN mice. J Dermatol. Apr. 2005;32(4):243-7.
Jirikowski, G.F., et al., Reversal of diabetes insipidus in Brattleboro Rats: Intrahypothalamic injection of vasopressin mRNA. Science. Feb. 1992; 255(5047): 996-998.
Johnson, K.M. et al., Role of heparan sulfate in attachment to and infection of the murine female gential tract by human papillomavirus. J Virol. Mar. 2009; 83(5): 2067-2074.
Jones, P.C.T., An Alteration in Cell Morphology under the Influence of a Tumor RNA. Nature, 1964,202:1226-7.
Juliano, R.L., et al., Cell-targeting and cell-penetrating peptides for delivery of therapeutic and imaging agents. Wiley Interdisciplinary Reviews: Nanomedicine and Nanobiotechnology. May/Jun. 2009; 1(3): 324-335.
Kabanov, A.V. et al., A new class of antivirals: antisense oligonucleotides combined with a hydrophobic substituent effectively inhibit influenza virus reproduction and synthesis of virus-specific proteins in MDCK cells. FEBS Lett. Jan. 1, 1990;259(2):327-30.
Kahan, F.M. et al., The role of deoxyribonucleic acid in ribonucleic acid synthesis. J Biological Chem. Dec. 1962; 287(12): 3778-3785.
Kaji, K., et al., Virus free induction of pluripotency and subsequent excision of reprogramming factors. Nature. Apr. 2009; 458(7239): 771-775.
Kalnins, A. et al., Sequence of the lacZ gene of *Escherichia coli*. EMBO J. 1983;2(4):593-7.
Kanaya, S. et al., Codon usage and tRNA genes in eukaryotes: correlation of codon usage diversity with translation efficiency and with CG-dinucleotide usage as assessed by multivariate analysis. J Mol Evol. Oct.-Nov. 2001;53(4-5):290-8.
Kandimalla, E.R. et al., Divergent synthetic nucleotide motif recognition pattern: design and development of potent immunomodulatory oligodeoxyribonucleotide agents with distinct cytokine induction profiles. Nucleic Acids Res. May 1, 2003;31(9):2393-400.
Kandimalla, E.R. et al., Immunomodulatory oligonucleotides containing a cytosine-phosphate-2'-deoxy-7-deazaguanosine motif as potent toll-like receptor 9 agonists. Proc Natl Acad Sci U S A. May 10, 2005:102(19):6925-30. Epub Apr. 28, 2005.
Karande, A.A.,et al., In vitro induction of chronic myeloid leukemia associated immune reactivity in normal human lymphocytes by xenogeneic immune RNA. Neoplasma. 1983, 30(4):403-9.
Kuhn, E., et al., Developing multiplexed assays for Troponin I and Interleukin-33 in plasma by peptide immunoaffinity enrichment and targeted mass spectrometry. Clinical Chem. 2009; 55(6): 1108-1117.
Kundu, T.K. et al., CpG islands in chromatin organization and gene expression. J Biochem. Feb. 1999;125(2):217-22.
Kusakabe, K. et al., The timing of GM-CSF expression plasmid administration influences the Th1/Th2 response induced by an HIV-1-specific DNA vaccine. J Immunol. Mar. 15, 2000;164(6):3102-11.
Kvasnica, M. et al., Platinum(II) complexed with steroidal esters of L-methonine and L-histidine: synthesis, characterization and cytotoxic activity. Bioorg Med Chem. Apr. 1, 2008;16(7):3704-13. Epub Feb. 7, 2008.
Kwoh, D.Y. et al., Transcription-based amplification system and detection of amplified human immunodeficiency virus type 1 with a bead-based sandwich hybridization format. Proc Natl Acad Sci U S A. Feb. 1989;86(4):1173-7.
Kwissa, M. et al., Cytokine-facilitated priming of CD8+ T cell responses by DNA vaccination. J Mol Med (Berl). Feb. 2003;81(2):91-101. Epub Nov. 22, 2002.
Lacour, F. et al., Transplantable malignant tumors in mice induced by preparations containing ribonucleic acid extracted from human and mouse tumors. J. Natl Cancer Inst., 1960, 24(2):301-27.
Lai, C.J. et al., Patterning of the neural ectoderm of Xenopus laevis by the amino-terminal product of hedgehog autoproteolytic cleavage. Development. Aug. 1995;121(8):2349-60.
Lai, S.K., et al., Rapid transport of large polymeric nanoparticles in fresh undiluted human mucus. PNAS. Jan. 30, 2007;104(5): 1482-1487.
Lai, S.K., et al., Mucus-penetrating nanoparticles for drug and gene delivery to mucosal tissues. Adv Drug Deliv Rev. Feb. 27, 2009; 61(2): 158-171.
Lange, T.S., et al., Transient nucleolar localization of U6 small nuclear RNA in Xenopus laevis oocytes. Mol Biol Cell. Jul. 2000;11(7):2419-28.

(56) References Cited

OTHER PUBLICATIONS

Langford, C.J. et al., Evidence for an intron-contained sequence required for the splicing of yeast RNA polymerase II transcripts. Cell. Jun. 1983;33(2):519-27.

Larregina, A.T. et al., Changing paradigms in cutaneous immunology: adapting with dendritic cells. J Invest Dermatol. Jan. 2005;124(1):1-12.

Latarjet, R., Production of multiple cancers in mice having received nucleic acid extract from isologous & homologous leukemic tissues. C.R. Hebd Seances Acad. Sci., 1958, 246(5):853-5.

Lathe, R., Synthetic oligonucleotide probes deduced from amino acid sequence data: Theoretical and practical considerations. J Mol Biol. May 5, 1985;183(1):1-12.

Leader B., et al., Protein therapeutics: a summary and pharmacological classification. Nat Rev Drug Discov. Jan. 2008; 7(1): 21-39.

Lee, G. et al., Modeling pathogenesis and treatment of familial dysautonomia using patient-specific iPSCs. Nature. Sep. 17, 2009;461(7262):402-6. Epub Aug. 19, 2009.

Lee, J. et al., Molecular basis for the immunostimulatory activity of guanine nucleoside analogs: activation of Toll-like receptor 7. Proc Natl Acad Sci U S A. May 27, 2003;100(11):6646-51. Epub May 8, 2003.

Lee, J. T., et al., An arginine to glutamine mutation in residue 109 of human ornithine transcarbamylase completely abolishes enzymatic activity in Cos1 cells. J. Clin. Invest. Dec. 1989; 84: 1762-1766.

Lehto, T., et al., Cell-penetrating peptides for the delivery of nucleic acids. Expert Opin. Drug Deliv. Jul. 2012; 9(7): 823-836.

Leitner, W.W. et al., DNA and RNA-based vaccines: principles, progress and prospects. Vaccine. Dec. 10, 1999;18(9-10):765-77.

Lenz, A. et al., Human and murine dermis contain dendritic cells. Isolation by means of a novel method and phenotypical and functional characterization. J Clin Invest. Dec. 1993;92(6):2587-96.

Lerner, M.R. et al., Are snRNPs involved in splicing? Nature. Jan. 10, 1980;283(5743):220-4.

Lesaffre, B. et al., Direct non-cell autonomous Pax6 activity regulates eye development in the zebrafish. Neural Dev. Jan. 17, 2007;2:2.

Lewandowski, L.J. et al., Separation of the infectious ribonucleic acid of potato spindle tuber virus from double-stranded ribonucleic acid of plant tissue extracts. J Virol. Nov. 1971;8(5):809-12.

Lewis, David, Dynamic Polyconjugates (DPC) Technology: An elegant solution to the siRNA delivery problem. Arrowhead Research Corp (NASDAQ: ARWR). Nov. 2011.

Lewis, J.D. et al., The influence of 5' and 3' end structures on pre-mRNA metabolism. J Cell Sci Suppl. 1995;19:13-9.

Lewis, J.K., et al., Matrix-assisted laser desorption/ionization mass spectrometry in peptide and protein analysis. Enc of Anal Chem. 2000; R.A. Meyers (Ed.) 5880-5894.

Li, L. et al., Preparation and gene delivery of alkaline amino acids-based cationic liposomes. Arch Pharm Res. Jul. 2008;31(7):924-31. Epub Aug. 14, 2008.

Li, L. et al., Overcoming obstacles to develop effective and safe siRNA therapeutics. Expert Opin Biol Ther. May 2009;9(5): 609-19.

Li, X. et al., Generation of destabilized green flourescent protein as a transcription reporter. J Biol Chem. Dec. 25, 1998;273(52):34970-5.

Lian, T. et al., Trends and developments in liposome drug delivery systems. J Pharm Sci. Jun. 2001;90(6):667-80.

Liang, X.H. et al., The spliced leader-associated RNA is a trypanosome-specific sn(o) RNA that has the potential to guide pseudouridine formation on the SL RNA. RNA. Feb. 2002;8(2):237-46.

Licatalosi, D.D. et al., Splicing regulation in neurologic disease. Neuron. Oct. 5, 2006;52(1):93-101.

Linehan, D.C. et al., Tumor-specific and HLA-A2 restricted cytolysis by tumor-associated lymphocytes in human metastatic breast cancer. J Immunol. Nov. 1, 1995;155(9):4486-91.

Lobenberg, R. et al., Improved body distribution of 14C-labelled AZT bound to nanoparticles in rats determined by radioimmunography. J Drug Target. 1998;5(3):171-9.

Loging, W.T. et al., Identifying potential tumor markers and antigens by database mining and rapid expression screening. Genome Res. Sep. 2000;10(9):1393-402.

Lopez, M.F., et al., Selected reaction monitoring-mass spectrometric immunoassay responsive to parathyroid hormone and related variants. Clinical Chem. 2010; 56(2): 281-290.

Lopez-Berestein, G. et al., Treatment of systemic fungal infections with liposomal amphotericin B. Arch Intern Med. Nov. 1989;149(11):2533-6.

Lorenzi, J.C., et al., Intranasal vaccination with messenger RNA as a new approach in gene therapy: Use against tuberculosis. BMC Biotechnocol. Oct. 2010; 10(77): 1-11.

Lowe, T.M. et al., A computational screen for methylation guide snoRNAs in yeast. Science. Feb. 19, 1999;283(5405):1168-71.

Lowry, W.E., et al., Generation of human induced pluripotent stem cells from dermal fibroblasts. Proc Natl Acad Sci USA. Feb. 2008; 105(8): 2883-2888.

Lukkonen, B.G. et al., A conditional U5 snRNA mutation affecting pre-mRNA splicing and nuclear pre-mRNA retention identifies SSD1/SRK1 as a general splicing mutant suppressor. Nucleic Acids Res. Sep. 1, 1999;27 (17):3455-65.

Lund, P.E., et al., Pseudovirions as vehicles for the delivery of siRNA. Pharm Res. Mar. 2010; 27(3): 400-420. Epub Dec. 9, 2009.

Luo, D. et al., Synthetic DNA delivery systems. Nat Biotechnol. Jan. 2000;18(1):33-7.

Ma, X. et al., Pseudouridylation (Psi) of U2 snRNA in *S. cerevisiae* is catalyzed by an RNA-independent mechanism. EMBO J. Apr. 15, 2003;22(8):1889-97.

Mackie, G.A., Vectors for the synthesis of specific RNAs in vitro. Biotechnology. 1988;10:253-67.

Maden, B.E.H. et al., Classical and novel approaches to the detection and localization of the numerous modified nucleotides in eukaryotic ribosomal RNA. Biochimie. 1995;77(1-2):22-9.

Langer, R., New methods of drug delivery. Science. Sep. 28, 1990;249(4976):1527-33.

Magee, W .E. et al., Marked stimulation of lymphocyte-mediated attack on tumor cells by target-directed liposomes containing immune RNA, Cancer Res., 1978, 38(4):1173-6.

Warren, L. et al. Highly efficient reprogramming to pluripotency and directed differentiation of human cells with synthetic modified mRNA. Cell Stem Cell. Nov. 5, 2010;7(5):618-30.

Kormann, M. et al. Expression of therapeutic proteins after delivery of chemically modified mRNA in mice, Nat Biotechnol. Feb. 2011;29(2):154-7.

Mannick, J.A. et al., Transformation of Nonimmune Lymph Node Cells to a State of Transplantation Immunity by RNA. A Preliminary Report, Ann. Surg., 1962, 156:356-66.

Mansour, S.L. et al., Disruption of the proto-oncogene int-2 in mouse embryo-derived stem-cells: a general strategy for targeting mutations to non-selectable genes. Nature, 1988, 336:348-52.

Mansour, et al., Functional Studies with Uterine RNA. PNAS, 1965, 53:764-70.

Marson, A., et al., Wnt signaling promotes reprogramming of somatic cells to pluripotency. Cell Stem Cell. Aug. 2008; 3(2): 132-135.

Martin, S.A. et al., Purification of mRNA guanylyltransferase and mRNA (guanine-7-) methyltransferase from vaccinia virions. J Biol Chem. Dec. 25, 1975;250(24):9322-9.

Martinon, F. et al., Induction of virus-specific cytotoxic T lymphocytes in vivo by liposome-entrapped mRNA. Eur J. Immunol. Jul. 1993;23(7):1719-22.

Massenet, S. et al., Pseudouridine mapping in the *Saccharomyces cerevisiae* spliceosomal U small nuclear RNAs (snRNAs) reveals that pseudouridine synthase pus1p exhibits a dual substrate specificity for U2 snRNA and tRNA. Mol Cell Biol. Mar. 1999;19(3):2142-54.

Mathers, A.R. et al., Professional antigen-presenting cells of the skin. Immunol Res. 2006;36(1-3):127-36.

(56) References Cited

OTHER PUBLICATIONS

Matray, T.J. et al., Synthesis and properties of RNA analogs-oligoribonucleotide N3'→P5' phosphoramidates. Nucleic Acids Res. Oct. 15, 1999;27(20):3976-85.
Maurer, N., et al., Spontaneous entrapment of polynucleotides upon electrostatic interation with ethanol-destabilized cationic liposomes. Biophys J. May 2001; 80(5): 2310-2326.
Mayfield, S.P. et al., Expression and assembly of a fully active antibody in algae. Proc Natl Acad Sci U S A. Jan. 21, 2003;100(2):438-42. Epub Jan. 8, 2003.
McCafferty, J et al., Phage antibodies: filamentous phage displaying antibody variable domains. Nature. Dec. 6, 1990;348(6301):552-4.
McCormack, A.L., et al., a-Synuclein suppression by targated small interfering RNA in the primate substantia nigra. PLoS ONE. Aug. 2010; 5(8): e12122.
McCormack, M., et al., Activation of the T-cell oncogene LMO2 after gene therapy for X-linked severe combined immunodeficiency. N Engl J Med. Feb. 2004; 350: 931-922.
McDonald, J.D., et al., Characterization of mutations at the mouse phenylalanine hydroxylase locus. Genomics. 1997; 39: 402-405.
McElwee, K.J. et al., Transfer of CB8(+) cells induces localized hair loss whereas CD4(+)/CD25(-) cells promote systemic alopecia areata and CD4(+)/CD25(+) cells blockade disease onset in the C3H/HeJ mouse model. J Invest Dermatol. May 2005;124(5):947-57.
McGee, M. et al., The Quantitative determination of phenylalanine hydroxylase in rat tissues. Biochem. J. 1972; 127:669-674.
McGlynn, R. et al., Differential subcellular localization of cholesterol, gangliosides, and glycosaminoglycans in murine models of mucopolysaccharide storage disorders. J Compl Neurol. Dec. 20, 2004;480(4):415-26.
McKenzie, B.S. et al., Nucleic acid vaccines: tasks and tactics. Immunol Res. 2001:24(3):225-44.
McLean, M.J., et al., Membrane differentiation of cardiac myoblasts induced in vitro by an RNA-enriched fraction from adult heart. Exp Cell Res. Nov. 1977;110(1):1-14.
MEGAscript Kit product Manual, Ambion/Invitrogen website: http://tools.invitrogen.com/content/sfs/manuals/cms_072987.pdf, Publication Date: Oct. 27, 2009 (last accessed Mar. 17, 2013).
Mellits, K.H. et al., Removal of double-stranded contaminants from RNA transcripts: synthesis of adenovirus VA RNAI from a T7 vector. Nucleic Acids Res. Sep. 25, 1990;18(18):5401-6.
Meunier, L. et al., Heterogeneous populations of class II MHC+ cells in human dermal cell suspensions. Identification of a small subset responsible for potent dermal antigen-presenting cell activity with features analogous to Langerhans cells. J Immunol. Oct. 15, 1993;151(8):4067-80.
Mignone, F. et al., Untranslated regions of mRNAs. Genome Biol. 2002;3(3):REVIEWS0004. Epub Feb. 28, 2002. pp. 1-10.
Minks, M.A. et al., Structural requirements of double-stranded RNA for the activation of 2',5'-oligo(A) polymerase and protein kinase of interferon-treated HeLa cells. J Biol Chem. Oct. 25, 1979;254(20):10180-3.
Mishra, N.C. et al., Induction by RNA of inositol independence in Neurospora crassa. Proc. Natl Acad. Sci. U.S.A., 1975, 72(2):642-5.
Mishra, R.K. et al., Improved leishmanicidal effect of phosphorotioate antisense oligonucleotides by LDL-mediated delivery. Biochim Biophys Acta. Nov. 7, 1995;1264(2):229-37.
Mitchell, D.A. et al., RNA transfected dendritic cells as cancer vaccines. Curr Opin Mol Ther. Apr. 2000:2(2):176-81.
Mitchell, D.A. et al., RNA-transfected dendritic cells in cancer immunotherapy. J Clin Invest. Nov. 2000;106(9):1065-9.
Mitchell, P. et al., mRNA turnover. Curr Opin Cell Biol. Jun. 2001;13(3):320-5.
Miura, K., et al., Variation in the safety of induced pluripotent stem cell lines. Nat Biotechnology. Aug. 2009; 27(8):743-745.
Morinaga, T. et al., Primary structures of human alpha-fetoprotein and its mRNA. Proc Natl Acad Sci U S A. Aug. 1983;80(15):4604-8.

Morse, M.A. et al., Generation of dendritic cells in vitro from peripheral blood mononuclear cells with granulocyte-macrophage-colony-stimulating factor, interleukin-4, and tumor necrosis factor-alpha for use in cancer immunotherapy. Ann Surg. Jul. 1997;226(1):6-16.
Mount, S.M. et al., A catalogue of splice junction sequences. Nucleic Acids Res. Jan. 22, 1982;10(2):459-72.
Muller, M.R. et al., Transfection of dendritic cells with RNA induces CD4- and CD8-mediated T cell immunity against breast carcinomas and reveals the immunodominance of presented T cell epitopes. J Immunol. Jun. 15, 2003;170(12):5892-6.
Murakawa, G.J. et al., Direct detection of HIV-1 RNA from AIDS and ARC patient samples. DNA. May 1988;7(4):287-95.
Myette, J.R. et al., Domain structure of the vaccinia virus mRNA capping enzyme. Expression in *Escherichia coli* of a subdomain possessing the RNA 5'-triphosphatase and guanylyltransferase activities and a kinetic comparison to the full-size enzyme. J Biol Chem. May 17, 1996;271(2):1936-44.
Nagata, S., et al., Molecular cloning and expression of cDNA for human granulocyte colony-stimumating factor. Nature. Jan. 30-Feb. 5, 1986; 319(6052): 415-8.
Nagata, S., et al., The chromosomal gene structure and two mRNAs for human granulocyte colony-stimulating factor. EMBO J. Mar. 1986; 5(3): 575-81.
Nagata, T. et al., Codon optimization effect on translational efficiency of DNA vaccine in mammalian cells: analysis of plasmid DNA encoding a CTL epitope derived from microorganisms. Biochem Biophys Res Commun. Aug. 2, 1999;261(2):445-51.
Nair, S. et al., Soluble proteins delivered to dendritic cells via pH-sensitive liposomes induce primary cytotoxic T lymphocyte responses in vitro. J Exp Med. Feb. 1, 1992;175(2):609-12.
Nair, S.K. et al., Antigen-presenting cells pulsed with unfractionated tumor-derived peptides are potent tumor vaccines. Eur J Immunol. Mar. 1997;27(3):589-97.
Nair, S.K. et al., Induction of cytotoxic T cell responses and tumor immunity against unrelated tumors using telomerase reverse transcriptase RNA transfected dendritic cells. Nat Med. Sep. 2000;6(9):1011-7.
Nair, S.K. et al., Induction of primary carcinoembryonic antigen (CEA)-specific cytotoxic T lymphocytes in vitro using human dendritic cells transfected with RNA. Nat Biotechnol. Apr. 1998;16(4):364-9.
Nakamura, K. et al., A model for the autosensitization autoantibody production associated with xenogeneic thymic RNA. J Immunol. Aug. 1978;121(2):702-9.
Nakamura, K. et al., Antigen restricted hybridization between antigen primed macrophage and thymic RNA. Immunol Commun. 1981;10(4-5):367-82.
Nakamura, K. et al., Conversion of immune response patterns from high to low and low to high by an RNase-sensitive thymocyte extract. Immunology. Sep. 1980;41(1):25-35.
Nakamura, K. et al., Generation of anti-NZB red blood cell antibody-forming plasma cells from bone marrow cultures of syngeneic and allogeneic mice: functional modulation of helper T-cell subsets in autosensitization. Immunology. Mar. 1983;48(3):579-86.
Nakamura, K. et al., Itranuclear incorporation of thymic low molecular weight RNA by murine bone marrow immunoblasts and inhibition of plasma cell formation by a derivative of rifampicin. Microbiol Immunol. 1982;26(1):41-57.
Nakamura, K. et al., Mechanism of anti-DNA antibody formation. The functional modulation of helper T-subset plays the key role in both murine and human B-cell autosensitization. Microbiol Immunol. 1986;30(7):703-15.
Ponsaerts, P. et al., Messenger RNA electroporation of human monocytes, followed by rapid in vitro differentiation, leads to highly stimulatory antigen-loaded mature dendritic cells. J Immunol. Aug. 15, 2002;169(4):1669-75.
Porgador, A. et al., Induction of antitumor imminity using bone marrow-generated dendritic cells. J Immunol. Apr. 15, 1996;156(8):2918-26.
Pradilla, G. et al., Prevention of vasospasm following subarachnoid hemorrhage in rabbits by anti-CD11/CD18 monoclonal antibody therapy. J Neurosurg. Jul. 2004;101(1):88-92.

(56) References Cited

OTHER PUBLICATIONS

Preisler, H.D. et al., Sensitization in vitro to murine myeloblastic leukemia cells by xenogeneic immune RNA. J Natl Cancer Inst. Jan. 1979;62(1):133-7.
Preiss, T. et al., Dual function of the messenger RNA cap structure in poly(A)-tall-promoted translation in yeast. Nature. Apr. 2, 1998;392(6675):516-20.
Probst, J., et al., Spontaneous cellular uptake to exogenous messenger RNA in vivo is nucleic acid-specific, saturable and ion dependent. Gene Therapy. 2007; 14: 1175-1180.
Puga, A., et al., Diference between functional and structural integrity of messenger RNA. Proc Natl Acad Sci U S A. Jul. 1973;70(7):2171-5.
Pulford, B., et al., Liposome-siRNA-peptide complexes cross the blood-brain barrier and significantly decrease PrP$^\wedge$ C on neuronal cells and PrP$\lambda$RES in infected cell cultures. PLoS ONE. 2010; 5(6): e11085.
Purchio, A.F. et al., [24] Methods for molecular cloning in eukaryotic cells. Methods Enzymol. 1979; 68:357-75.
Query, C.C. et al., Branch nucleophile selection in pre-mRNA splicing; evidence for the bulged duplex model. Genes Dev. Mar. 1, 1994;8(85):587-97.
Rabinovich, P.M., et al., Synthetic messenger RNA as a tool for gene therapy. Hum. Gen Ther. Oct. 2006; 17:1027-1035.
Rabinovich, P.M., et al., Chemeric receptor mRNA transfection as a tool to generate Antineoplastic Lymphocytes. Hum. Gene Ther. Jan. 2009; 20: 51-61.
Raff, M., Adult stem cell plasticity: fact or artifact? Annu Rev Cell Biol. 2003;19:1-22.
Rajagopalan, L.E. et al., Turnover and translation of in vitro synthesized messenger RNAs in transfected, normal cells. J Biol Chem. Aug. 16, 1996;271(33):19871-6.
Ramazeilles, C. et al., Antisense phoaphorothioale oligonucleotides: selective killing of the intracellular parasite Leishmania amazonensis. Proc Natl Acad Sci U S A. Aug. 16, 1994;91(17):7859-63.
Rammensee, H.G. et al., Peptides naturally presented by MHC class I molecules. Annu Rev Immunol. 1993;11:213-44.
Rascati, R.J. et al., Characterization of Fv-1 gene-produce-mediated resistance transfer. Interivrology. 1981;15(2):87-96.
Ratajczak, J. et al., Embryonic stem cell-derived microvesicles reprogram hematopoletic progenitors: evidence for horizontal transfer of mRNA and protein delivery. Leukemia. May 2006;20(5):847-56.
Ratajczak, J. et al., Membrane-derived microvesicles: important and underappreciated mediators of cell-to-cell communication. Leukemia. Sep. 2006;20(9):1487-95. Epub Jul. 20, 2006.
Read, M.L., et al., A versatile reducible polycation-based system for efficient delivery of a broad range of nucleic acids. Nucleic Acids Res. 2005; 33(9): e86.
Reddy, A. et al., The effect of labour and placental separation on the shedding of syncytiotrophoblast microparticles, cell-free DNA and mRNA in normal pregnancy and pre-eclampsia. Placenta. Nov. 2008;29(11):942-9. Epub Oct. 1, 2008.
Reed, R. et al., Intron sequences involved in lariat formation during pre-mRNA splicing. Cell. May 1985;41(1):95-105.
Regnier, P. et al., Degradation of mRNA in bacteria; emergence of ubiquitous features. Bioessays. Mar. 2000;22(3):235-44.
Rejman, J., et al., mRNA transfection of cervical carcinoma and mesenchymal stem cells mediated by cationic carriers. J Controlled Rel. Nov. 2010; 147(3): 385-391.
Renkvist, N. et al., A listing of human tumor antigens recognized by T cells. Cancer Immunol Immunother. Mar. 2001;50(1);3-15.
Reyes-Sandoval, A. et al., DNA Vaccines. Curr Mol Med. May 2001;1(2):217-43.
Reynolds, B.A. et al., Generation of neurons and astrocytes from isolated cells of the adult mammalian central nervous system. Science. Mar. 27, 1992;255(5052):1707-10.
Ruhnke, M. et al., Long-term culture and differentiation of rat embryonic stem cell-like cells into neuronal, glial, endothelial, and hepatic lineages. Stem Cells. 2003;21(4):428-36.
Richter, J.D., Cytoplasmic polyadenylation in development and beyond. Microbiol Mol Biol Rev. Jun. 1999;63(2):446-56.
Roberts, J.N. et al., Genital transmission of HPV in a mouse model is potentiated by nonoxynol-9 and inhibited by carrageenan. Nat Med. Jul. 2007; 13(7): 857-861.
Robbins, P.F. et al., Human tumor antigens recognized by T cells. Curr Opin Immunol. Oct. 1996;8(5):628-36.
Robinson, F. et al., Expression of human nPTB is limited by extreme suboptimal codon content. PLoS One, Mar. 12, 2008;3(3):e1801.
Robinson, H.L. et al., Protection against a lethal influenza virus challenge by immunization with a heamagglutinin-expressing plasmid DNA. Vaccine. 1993;11(9):957-60.
Robles, A.I. et al., Reduced skin tumor development in cyclin D1-dificient mice highlights the oncogenic ras pathway in vivo. Genes Dev. Aug. 15, 1998;12(16):2469-74.
Rock, K.L. et al., A new foreign policy: MHC class I molecules monitor the outside world. Immunol Today. Mar. 1996;17(3):131-7.
Rodriguez, P.L., et al., Minimal "self" peptides that inhibit phagocytic clearance and enhance delivery of nanoparticles. Science. Feb. 22, 2013; 339(6122): 971-975.
Rohloff, C.M., et al., DUROS® Technology delivers peptides and proteins at consistent rate continuously for 3 to 12 months. J Diabetes Sci Technol. May 2008; 2(3): 461-467.
Romani, N. et al., Generation of mature dendritic cells from human blood. An improved method with special regard to clinical applicability. J Immunol Methods. Sep. 27, 1996;196(2):137-51.
Romani, N. et al., Presentation of exogenous protein antigens by dendritic cells to T cell clones. Intact protein is presented best by immature, epidermal Langerhans cells. J Exp Med. Mar. 1, 1989;189(3):1169-78.
Rosa, A., et al., Synthetic mRNAs: Powerful tools for reprogramming and differentiation of human cells. Cell Stem Cell. Nov. 2010; 7: 549-550.
Rosenberg, S.A. et al., Cancer immunotherapy: moving beyond current vaccines. Nat Med. Sep. 2004;10(9):909-15.
Ross, B.S. et al., Synthesis and incorporation of 2'-O-methyl-pseudouridine into oligonucleotides. Nucleosides and Nucleotides. 1997; 16(7/9):1547-9.
Ross, J. Control of messenger RNA stability in higher eukaryotes. Trends Genet. May 1996;12(5):171-5.
Rossi, Derrick, Open letter Entitled "Change to mRNA Reprogramming Protocol" Publication Date: Aug. 13, 2011 (available at Addgene website: http://www.addgene.org/static/data/83/87/3686c0f2-c9a2-11e0-b8a9-003048dd6500.pdf, last retrieved Mar. 17, 2013).
Ryser, M., et al., S1P1 overexpression stimulates S1P-dependent chemotaxis of human CD34+ hematopoietic progenitor cells but strongly inhibits SDF-1/CXCR4-dependent migration and in vivo homing. Mol Immunology. 2008; 46: 166-171.
Saenz-Badillos, J. et al., RNA as a tumor vaccine: a review of the literature. Exp Dermatol. Jun. 2001;10(3):143-54.
Saison-Behmoaras, T. et al., Short modified antisense oligonucleotides directed against Ha-ras point mutation induce selective cleavage of the mRNA and inhibit T24 cells proliferation. EMBO J. May 1991;10(5):1111-8.
Saito, K. et al., Cell participation in immune response by immune ribonucleic acid. I. The role of T lymphocytes in immune response by immune RNA against T-depedent antigens. Immunology. Dec. 1980;41(4):937-45.
Saito, R., et al., Distribution of liposomes into brain and rat brain tumor models by convetion-enhanced delivery monitored with magnetic resonance imaging. Cancer Res. Apr. 2004; 64: 2572-2579.
Sakuma, S. et al., Mucaodhesion of polystyrene nanoparticles having surface hydrophilic polymeric chains in the gastrointestinal tract. Int J Pharm. Jan. 25, 1999;177(2):161-72.
Sallusto, F. et al., Dendritic cells use macropinocytosis and the mannose receptor to concentrate macromolecules in the major

(56) References Cited

OTHER PUBLICATIONS histocompatibility complex class II compartment: downregulation by cytokines and bacterial products. J Exp Med. Aug. 1, 1995;182(2):389-400.
Sallusto, F. et al., Efficient presentation of soluble antigen by cultured human dendritic cells is maintained by granulocyte/macrophage colony-stimulating factor plus interleukin 4 and downregulated by tumor necrosis factor alpha. J Exp Med. Apr. 1, 1994;179(4):1109-18.
Veres, G., et al., The molecular basis of the sparse fur mouse mutation. Science. Jul. 1987;237(4813):415-7.
Verheggen, C. et al., Box C/D small nucleolar RNA trafficking involves small nucleolar RNP proteins, nucleolar factors and a novel nuclear domain. EMBO J. Oct. 1, 2001;20(19):5480-90.
Verheggen, C. et al., Mammalian and yeast U3 snoRNPs are matured in specific and related nuclear compartments. EMBO J. Jun. 3, 2002;21(11):2736-45.
Verma, I.M. et al., Gene therapy: promises, problems and prospects. Nature. Sep. 18, 1997;389(6648):239-42.
Verma, I.M. et al., Gene therapy: twenty-first century medicine. Annu Rev Biochem. 2005;74:711-38.
Verma, S. et al., Modified oligonucleotides: synthesis and strategy for users. Annu Rev Biochem. 1998;67:99-134.
Vilee, D.B., Ribonucleic acid; control of steroid synthesis in endocrine tissue. Science. Nov. 3, 1967;158(3801):652-3.
Villaret, D.B. et al., Identification of genes overexpressed in head and neck squamous cell carcinoma using a combination of complementary DNA subtraction and microarray analysis. Laryngoscope. Mar. 2000;110(3 Pt 1):374-81.
Virovic, L. et al., Novel delivery methods for treatment of viral hepatitis: an update. Exppert Opin Drug Deliv. Jul. 2005;2(4):707-17.
Viza, D. et al., Human lymphoblastoid cells in culture replicate immune information carried by xenogeneic RNA. Differentiation. 1978;11(3):181-4.
Wagner, E. Polymers for siRNA delivery: Inspired by viruses to be targeted, dynamic, and precise. Acc Chem Res. 2012; 45(7): 1005-1013.
Wahle, E. Poly(A) tail length control is caused by termination of processive synthesis. J Biol Chem. Feb. 10, 1995; 270(6): 2800-2808.
Wang, B. et al., Gene inoculation generates immune responses against human immunodeficiency virus type 1. Proc Natl Acad Sci U S A. May 1, 1993;90(9):4156-60.
Wang, B. et al., Immunization by direct DNA inoculatuion induces rejection of tumor cell challenge. Hum Gene Ther. Apr. 1995;6(4):407-18.
Wang, B.S. et al., Fractionation of immune RNA capable of transferring tumor-specific cellular cytotoxicity. Cell Immunol. May 1978;37(2):358-68.
Wang, S.P. et al., Phylogeny of mRNA capping enzymes. Proc Natl Acad Sci U S A. Sep. 2, 1997;94(18):9573-8.
Wang, Y., et al., Systemic delivery of modified mRNA enoxiing herpes simplex virus 1 thymidine kinase for targeted cancer gene therapy. Mol Therapy. 2012; 11: 1-10.
Warren, T.L. et al., Uses of granulocyte-macrophage colony-stimulating factor in vaccine development. Curr Opin Hematol. May 2000;7(3):168-73.
Weaver, J.C., Electroporation theory. Concepts and mechanisms. Methods Mol Biol. 1995;55:3-28.
Watanabe, T. et al., Induction of wild-type p53 activity in human cancer cells by ribozymes that repair mutant p53 transcripts. Proc Natl Acad Sci U S A. Jul. 18, 2000;97(15):8490-4.
Weber, J. et al., Granulocyte-macrophage-colony-stimulating factor added to a multipeptide vaccine for resected Stage II melanoma. Cancer. Jan. 1, 2003;97(1):186-200.
Weide, B. et al., Results of the first phase I/II clinical vaccination trial with direct injection of mRNA. J Immunother. Feb.-Mar. 2008;31(2):180-8.
Weide, B., et al., Direct injection of protamine-protected mRNA: Results of a phase 1/2 vaccination trial in metastatic melanoma patients. J. of Immunotherapy. Jun. 2009; 32(5): 498-507.
Nakamura, O. et al., Abstract: The Role of Immune RNA in the Immunotherapy of Malignant Brain Tumor. 1982, 34(2);333-9.
Weisberger, A.S., Induction of altered globin synthesis in human immature erythrocytes incubated with ribonucleoprotein. Proc Natl Acad Sci USA. Jan. 1962; 48(1): 68-80.
Weiss, S.B. et al., Pseudouridine Formation: Evidence for RNA as an Intermediate. Science. Jul. 23, 1965: 149(3682): 429-431.
Weissman, D. et al., Dendritic cells express and use multiple HIV coreceptors. Adv Exp Med Biol. 1997;417:401-6.
Weissman, D. et al., HIV GAG mRNA transfection of dendritic cell (DC) delivers encoded antigen to MHC class I and II molecules, causes DC maturation, and induced a potent human in vitro primary immune response. J Immunol. Oct. 15, 2000;165(8):4710-7.
Wels, W., et al., Construction, bacterial expresion and characterization of a bifunctional single-chain antibody-phosphate fusion protein targeted to the human erbb-2 receptor. Biotechnology (NY). Oct. 1992; 10(10): 1128-1132.
Wickens, M. et al., A PUF family portrait: 3'UTR regulation as a way of life. Trends Genet. Mar. 2002;18(3):150-7.
Wiehe, J.M. et al., mRNA-mediated gene delivery into human progenitor cells promotes highly efficient protein expression. J Cell Mol Med. May-Jun. 2007;11(3):521-30.
Wilkie, G.S. et al., Regulation of mRNA translation by 5'- and 3'-UTR-binding factors. Trends Biochem Sci. Apr. 2003;28(4):182-8.
Wilusz, C.J. et al., Bringing the role of mRNA decay in the control of gene expression into focus. Trends Genet. Oct. 2004;20(10):491-7.
Wilusz, J. et al., A B4 kd nuclear protein binds to RNA segments that include the AAUAAA polyadenylation motif. Cell. Jan. 29, 1988;52(2):221-8.
Winnicka, B, et al., CD13 is dispensable for normal hematopoiesis and myeloid cell functions in the mouse. J Leukoc Biol. Aug. 2010: 88(2); 347-359. Epub Apr. 29, 2010.
Wolff, J.A. et al., Direct gene transfer into mouse muscle in vivo. Science. Mar. 23, 1990;247(4949 Pt 1):1465-8.
Woltjen, K. et al., piggyBac transposition reprograms fibroblasts to induced pluripotent stem cells. Nature. Apr. 2009 (458): 10.1038-07863.
Woodberry, T. et al., Immunogenicity of a human immunodeficiency virus (HIV) polytope vaccine containing multiple HLA A2 HIG CD8(+) cytotoxic T-cell epitopes. J Virol. Jul. 1999;73(7):5320-5.
Wu, J. et al., Mammalian pre-mRNA branch site selection by U2 snRNP involves base pairing. Genes Dev. Oct. 1989;3(10):1553-61.
Wu, L. et al., Fusion protein vectors to increase protein production and evaluate the immunogenicity of genetic vaccines. Mol Ther. Sep. 2000;2(3):288-97.
Wu, X.C. et al., Engineering a Bacillus subtilis expression-secretion system with a strain deficient in six extracellular proteases. J Bacteriol. Aug. 1991;173(16):4952-8.
Wurm, F. et al., Suppression of melanoma development and regression of melanoma in xiphophorine fish after treatment with immune RNA. Cancer Res. Sep. 1981;41(9 Pt 1):3377-83.
Wyatt, J.R. et al., Site-specific cross-linking of mammalian U5 snRNP to the 5' splice site before the first step of pre-mRNA splicing. Genes Dev. Dec. 1992;6(12B):2542-53.
Xu, C. et al., Feeder-free growth of undifferentiated human embryonic stem cells. Nat Biotechnol. Oct. 2001;19(10):971-4.
Xu, J. et al., Identification of differentially expressed genes in human prostate cancer using subtraction and microarray. Cancer Res. Mar. 15, 2000;60(6):1677-82.
Yamamoto, A., et al., Current prospects for mRNA gene delivery. Eur J Pharm Biopharm. Mar. 2009; 71(3): 484-489.
Yamashita, A. et al., Concerted action of poly(A) nucleases and decapping enzyme in mammalian mRNA turnover. Nat Struct Mol Biol. Dec. 2005;12(12):1054-63. Epub Nov. 13, 2005.
Yang, S.F. et al., Albumin synthesis in mouse uterus in response to liver mRNA. Proc Natl Acad Sci U S A. May 1977;74(5):1894-8.

(56) References Cited

OTHER PUBLICATIONS

Ye, X., et al., Prolonged metabolic correction in adult ornithine transcarbamylase-deficient mice with adenoviral vectors. Biological Chem. Feb. 1996; 271(7): 3639-3646.
Yi, Y., et al., Current advances in retroviral gene therapy. Current Gene Ther. 2011; 11: 218-228.
Ying, H. et al., Cancer therapy using a self-replicating RNA vaccine. Nat Med. Jul. 1999;5(7):823-7.
Yisraeli, J.K. et al., [4] Synthesis of long, capped transcripts in vitro by SP6 and T7 RNA Polymerases. Methods in Enzymology, vol. 180. 1989; 180, 42-50.
Yokoe, H. et al., Spatial dynamics of GFP-tagged proteins investigated by local fluorescence enhancement. Nat Biotechnol. Oct. 1996;14(10):1252-6.
Yoshida, Y. et al., Hypoxia enhances the generation of induced pluripotent stem cells. Cell Stem Cells 5, Sep. 2009; 5: 237-241.
You, Z. et al., A retrogen strategy for presentation of an intracellular tumor antigen as an exogenous antigen by dendritic cells induces potent antitumor T helper and CTL responses. Cancer Res. Jan. 1, 2001;61(1):197-205.
Yu, J. et al., Structural and functional analysis of an mRNP complex that mediates the high stability of human beta-globin mRNA. Mol Cell Biol. Sep. 2001;21(17):5879-88.
Yu, J. et al., Induced pluripotent stem cell lines derived from human somatic cells. Science. Dec. 21, 2007; 318(5856): 1917-1920.
Yu, J. et al., Human induced pluripotent stem cells of vector and transgene sequences. Science. May 8, 2009; 324(5938): 797-801.
Yu, P.W. et al., Sustained correction of B-cell development and function in a murine model of X-linked agammaglobulinemia (XLA) using retroviral-mediated gene transfer. Sep. 1, 2004;104(5):1281-90. Epub May 13, 2004.
Yu, Y.T. et al., Internal modification of U2 small nuclear (sn)RNA occurs in nucleoli of Xenopus oocytes. J Cell Biol. Mar. 19, 2001;152(6):1279-88.
Yu, Y.T. et al., Modifications of U2 snRNA are required for snRNP assembly and pre-mRNA splicing. EMBO J. Oct. 1, 1998;17(19):5783-95.
Zebarjadian, Y. et al., Point mutations in yeast CBF5 can abolish in vivo pseudouridylation of rRNA. Mol Cell Biol. Nov. 1999;19(11):7461-72.
Zeitlin, S. et al., In vivo splicing products of the rabbit beta-globin pre-mRNA. Cell. Dec. 1984;39(3 Pt 2):589-602.
Zelcer, A. et al., The detection and characterization of viral-related double-stranded RNAs in tobacco mosaic virus-infected plants. Virology. Sep. 1981;113(2):417-27.
Zeytin, H.E. et al., Construction and characterization of DNA vaccines encoding the single-chain variable fragment of the anti-idiotype antibody 1A7 mimicking the tumor-associated antigen disialoganglioside GD2. Cancer Gene Ther. Nov. 2000;7(11):1426-36.
Zhang, X. et al., Advances in dendritic cell-based vaccine of cancer. Cancer Biother Radiopharm. Dec. 2002;17(6):601-19.
Zhang, Y., et al., In vivo gene delivery by nonviral vectors: overcoming hurdles? Mol. Therapy. Jul. 2012; 20(7): 1298-1304.
Zhao, X. et al., Pseudouridines in and near the branch site recognition region of U2 snRNA are required for snRNP biogenesis and pre-mRNA splicing in Xenopus oocytes. RNA. Apr. 2004;10(4):681-90.
Zhigaltsev, I.V., et al., Bottom-Up design and synthesis of limit size lipid nanoparticle systems with aqueous and triglyceride cores using millisecond microfluidic mixing. Langmuir. Feb. 21, 2012; 28(7): 3633-3640.
Zhou, W.Z. et al., RNA melanoma vaccine: induction of antitumor immunity by human glycoprotein 100 mRNA immunization. Hum Gene Ther. Nov. 1, 1999;10(16):2719-24.
Zhou, H., et al., Generation of induced pluripotent stem cells using recombinant proteins. Cell Stem Cell. May 4, 2009(5):381-4.
Zhou, J., et al., Short Communicatiobn Bilirubin Glucuronidation Revisited: Proper assay conditions to estimate enzyme kinetics with recombinant UGT1A1. Drug metabolism and Disp. 2010; 38(11): 1907-1911.
Zhuang, Y. et al., A compensatory base change in human U2 snRNA can suppress a branch site mutation. Genes Dev. Oct. 1989;3(10):1545-52.
Zimmermann, E. et al., Electrolyte- and pH-stabilities of aqueous solid lipid nanoparticle (SLN™) dispersions in artificial gastrointestinal media. Eur J Pharm Biopharm. Sep. 2001;52(2):203-10.
Zitvogel, L. et al., Therapy of murine tumors with tumor peptide-pulsed dendritic cells: dependence on T cells, B7 costimulation, and T helper cell 1-associated cytokines. J Exp Med. Jan. 1, 1996;183(1);87-97.
Zohra, F.T., et al., Drastic effect of nanoapatite particles on liposome-mediated mRNA delivery to mammalian cells. Analytical Biochem. Oct. 2005; 345(1): 164-166.
Zohra, F.T., et al., Effective delivery with enhanced translational activity synergistically accelerates mRNA-based transfection. Biochem Biophys Res Comm. Jun. 2007; 358(1): 373-378.
Zonta, S. et al., Uretero-neocystostomy in a swine model of kidney transplantation: a new technique. J Surg Res. Apr. 2005;124(2):250-5.
Zorio, D.A. et al., Both subunits of U2AF recognize the 3' splice site in Caenorhabditis elegans . Nature. Dec. 16, 1999;402(6763):835-8.
Chang, N. et al., Genome editing with RNA-guided Cas9 nuclease in Zebrafish embryos. Cell Res. Apr. 23, 2013(4):465-472.
Cong, L. et al., Multiplex genome engineering using CRISPR/Cas systems. Science. Feb. 15, 2013; 339(6121): 819-823.
Jinek, M. et al., A programmable dual-RNA-guided DNA endonuclease in adaptive bacterial immunity. Science. Aug. 17, 2012; 337(6096): 816-821.
Jinek, M. et al., RNA-programmed genome editing in human cells. Elife. 2013;2:e00471.
Maehr, R. et al., Generation of pluripotent stem cells from patients with type 1 diabetes. Proc Natl Acad Sci USA. Sep. 15, 2009; 106(37): 15768-15773.
Mali, P. et al., RNA-guided human genome engineering via Cas9. Science. Feb. 15, 2013; 339(6121): 823-826.
Qi, L.S. et al., Repurposing CRISPR as an RNA-guided platform for sequence-specific control of gene expression. Cell. Feb. 28, 2013: 152(5): 1173-1183.
Shen, B. et al., Generation of gene-modified mice via Cas9/RNA-mediated gene targeting. Cell Res. Apr. 2, 2013; 1-4.
International Search Report from International Application No. PCT/US10/059317 dated Aug. 22, 2011.
International Search Report from International Application No. PCT/US10/059305 dated Aug. 23, 2011.
Yi, P. et al., Betatrophin: A hormone that control pancreatic beta cell proliferation. Cell. May 9, 2013, 153: 1-12.
Graf, T and Enver T. Forcing cells to change lineages. Nature. Dec. 3, 2009; 462(7273): 587-594.
Ieda, M. et al., Direct reprogramming of fibroblasts into functional cardiomyocytes by defined factors. Cell. Aug. 6, 2010; 142(3); 375-386.
Huangfu, D. et al., Induction of pluripotent stem cells from primary human fibroblasts with only Oct4 and Sox2. Nat Biotechnol. Nov. 2008; 26(11): 1269-1275.
Dong, X.Y. et al., Identification of genes differentially expressed in human hepatocellular carcinoma by a modified suppression subtractive hybridization method. Int J Cancer. Nov. 1, 2004; 112(2): 239-248.
Okita, K. et al., Generation of mouse induced pluripotent stem cells without viral vectors. Science. 2008; 322: 949-953.
Stadtfeld, M. et al., Induced pluripotent stem cells generated without viral integration. Science. Nov. 7, 2008; 322(5903): 945-949.
Aoi, T. et al., Generation of pluripotent stem cells from adult mouse liver and stomach cells. Science. Aug. 1, 2008; 321 (6889): 699-702.
Feng, R. et al., PU.1 and C/EBPalpha/beta convert fibroblasts into macrophage-like cells. Proc Natl Acad Sci USA. Apr. 22, 2008; 105(16): 6057-6062.

(56) References Cited

OTHER PUBLICATIONS

Szabo, E. et al., Direct conversion of human fibroblasts to multilineage blood progenitors Nature. Nov. 25, 2010; 468(7323): 521-526.
Gonzalez, F. et al., Generation of mouse-induced pluripotent stem cells by transient expression of a single nonviral polycistronic vector. Proc Natl Acad Sci USA. Jun. 2, 2009; 106(22): 8918-8922.
Aasen, T. et al., Efficient and rapid generation of induced pluripotent stem cells from human keratinocytes. Nat Biotechnol. Nov. 2008: 26(11): 1276-1284.
Ebert, A.D. et al., Induced pluripotent stem cells from a spinal muscular atrophy patient. Nature. Jan. 15, 2009; 457 (7227): 277-280.o.
Vierbuchen, T. et al., Direct conversion of fibroblasts to functional neurons by defined factors. Nature. Feb. 25, 2010; 463(7284): 1035-1041.
Racila, D. et al., Transient expresion of OCT4 is sufficient to allow human keratinocytes to change their differentiation pathway. Gene Ther. Mar. 2011; 18(3): 294-303.
Nakagawa, M. et al., Generation of induced pluripotent stem cells without Myc from mouse and human fibroblasts. Nat Biotechnol. Jan. 2008: 26(1); 101-106. Epub Nov. 30, 2007.
Haft, D.H. et al., A guild of 45 CRISPR-associated (Cas) protein families and multiple CRISPR/Cas subtypes exist in prokaryotic genomes. PLoS Comput Biol. Nov. 2005; 1(6): e60. Epub Nov. 11, 2005.
Brown, C.E., et al., Poly(A) Tail Lengeth Control in *Saccharomyces cerevisiae* Occurs by Message-Specific Deadenylation. Molecular and Cellular Biology. Nov. 1998 p. 6548-6569.
Gao, G., et al., Erythropoietin gene therapy leads to autoimmune anemia in macaques. 2004 103: 3300-3302.
Liu, C., et al., Peptidoglycan Recognition Proteins. A Novel Family of Four Human Innate Immunity Pattern Recognition Molecules. The Journal of Biological Chemistry. vol. 276, No. 37, Issue of Sep. 14, pp. 686-34694, 2001.
Lu, X., Peptidoglycan Recognition Proteins are a New Class of Human Bactericidal Proteins. The Journal of Biological Chemistry. Mar. 3, 2006, vol. 281, No. 9, pp. 5895-5907.
Ngai, P.H.K., et al., Agrocybin, an antifungal peptide from the edible mushroom. Department of Biochemistry, The Chinese University of Hong Kong. Peptides 26 (2005) 191-196.
Endo, F., et al., A Nonsense Mutation in the 4-Hydroxyphenylpyruvic Acid Dioxygenase Gene (Hpd) Causes Skipping of the Constitutive Exon and Hypertyrosinemia in Mouse Strain III. Genomics 25, 164-169 (1995).
Neve, S., et al. Tissue distribution, intracellular localization and proteolytic processing of rat 4-hydorxyphenylpyruvate dioxygenase. Cell Biology International 27 (2003) pp. 611-624.
Ren, W., et al. Molecular clong and characterization of 4-hydroxyphenylpyruvate dioxygenase gene from Lactuca sativa. Journal of Patent Physiology 168 (2011 pp. 1076-1083).
Ruetschu, U., et al. Human 4-Hydroxyphenylpyruvate Dioxygenase Gene (HPD). Genomics 44, pp. 292-299 (1997).
Seabury, C.M., et al., Analysis of sequence variability and protein domain architectures for bovine peptidoglycan recognition protein 1 and Toll-like receptors 2 and 6. Genomics 92 (2008) pp. 235-245.
Sumathipala, N. et al., Involvement of Manduca sexta peptidoglycan recognition protein-1 in the recognition of bacteria and activation of prophenoloxidase system. Insect Biochemistry and Molecular Biology 40 (2010) 487-495.
Wei, X. et al., Molecular cloning and MRNA expression of two peptidogluycan recognition protein (PGRP genes from mollusk Solen grandis. Fish & Shellfish Immunology 32 (2012) 178-185.
Anonymous: "Messenger RNA". Internet: Wikipedia. Jun. 19, 2013, XP002699196, Retrieved from the Internet: URL: http://en.wikipedia.org/wiki/Messenger RNA.
Grosjean, H., DNA and RNA Modification Enzymes Structure, Mechanisms, Functions and Evolution. Molecular Biology Intelligence Unit. Estimated Publication Date: May 2009. pp. 1-2.

Grosjean, H., Nucleic Acids are not Boring Long Polymers of Only Four Types of Nucleotides: A Guided Tour. Chapter 1. Landes Bioscience. 2009. pp. 1-18.
Grosjean, H., et al. How Nucleic Acids Cope with High Temperature. Physiology and Biochemistry of Extremophiles. 2007. Chapter 4, pp. 39-58.
Grosjean, H., Modification and editing of RNA: historical overview and important facts to remember. pp. 1-22.
Hunt, D.M., et al., The L Protein of Vesicular Stomatitis Cirus Modulates the Response of the Polyadenylic Acid Polymerase to S-Adenosylhomocysteine. J. gen. Virol. (1988), 69, 2555-2561.
Grosjean, H., et al. Fine-Tuning of RNA Functions by Modification and Editing. Topics in Current Genetics, vol. 12, 2005, XXIV, p. 442.
Bouloy, M., et al., Both the 7-methyl and the 2'-O-methyl groups in the cap of mRNA strongly influence its ability to act as primer for influenza virus RNA transcription. Proc. Natl. Acad. Sci. USA, vol. 77, No. 7, pp. 3952-3956, Jul. 1980.
Fernandez, I., et al. Unusual base pairing during the decoding of a stop codon by the ribosome. vol. 000, 2013. pp. 1-5.
Edelheit, S. et al., Transcriptome-Wide Mapping of 5-methylcytidine RNA Modifications in Bacteria, Archaea, and Yeast Reveals m5C within Archaeal mRNAs. PLOS Genetics, Jun. 2013, vol. 9, Issue 6, pp. 1-14.
Cun, Dongmei, et al., Preparation and characterization of poly(DL-lactide-co-glycolide) nanoparticles for siRNA delivery. International Journal of Pharmaceutics 390 (2010) 70-75.
Oster, C.G., et al., Comparative study of DNA encapsulation into PLGA microparticles using modified double emulsion methods and spray drying techniques. Journal of Microencapsulation, May 2005; 22(3): 235-244.
GenBank: Homo sapiens 15 kDA selenoprotein (SEP 15), transcript variant 1, mRNA, NCBI Reference sequence: NM_004261.3, pp. 1-4.
Thomson A. James., et al. Isolation of a primate embryonic stem cell line. vol. 92, pp. 7844-7848, Aug. 1995. Proc. Natl. Acad. Sci. USA.
Tahiliani., et al.Conversion of 5-Methylcytosine to 5-Hydroxymethylcytosine in Mammalian DNA by MLL Partner TET1 Science 323, 930 (2009);www.sciencemag.org.
The Human Embryonic Stem Cell and the Human Embryonic Germ Cell. NIH Stem Cells: Scientific Progress and Future Research Directions, Department of Health and Human Services, Chapter 3, Jun. 2001.
The Stem Cell. NIH Stem Cells: Scientific Progress and Future Research Directions, Department of Health and Human Services, Chapter 1, Jun. 2001.
Morgan, D. Hugh, et al. Molecular Basis of Cell and Developmental Biology:Activation-induced Cytidine Dreaminase Deaminates 5-Methylcytosine in DNA and is Expressed in Pluripotent Tissues: Implications for Epigenetic Reprogramming. J. Biol. Chem. 2004, 279:52353-52360 published online Sep. 24, 2004.
Moore, J.E., et al., The Corneal Epithelial Stem Cell. vol. 21, Nos. 5/6, 2002. Mary Ann Liebert, Inc. pp. 443-451.
Koh, Peng Kian, et.al. Tet1 and Tet2 Regulate 5-Hydroxymethylcytosine Production and Cell Lineage Specification in Mouse Embryonic Stem Cells. 200-213, Feb. 4, 2011 2011 Elsevier Inc.
Kariko, Katalin, et.al. Naturally occurring nucleoside modifications suppress the immunostimulatory activity of RNA: Implication for therapeutic RNA development. Current Opinion in Drug Discovery & Development 2007 10(5): 523-532 The Thomson Corporation ISSN 1367-6733.
Ito, Shinsuke, et.al. Role of Tet proteins in 5mC to 5hmC conversion, ES-cell self-renewal and inner cell mass specification. vol. 466|Aug. 26, 2010| Macmillan Publishers Limited. pp. 1129-1133.
Freudenberg, M. Johannes, et.al. Acute depletion of Tet1-dependent 5-hydroxymethylcytosine levels impairs LIF/Stat3 signaling and results in loss of embryonic stem cell identity. Published online Dec. 30, 2011. 3364-3377 Nucleic Acids Research, 2012, vol. 40, No. 8.Published by Oxford University Press 2011.

(56) References Cited

OTHER PUBLICATIONS

Ficz, Gabriella, et al. Dynamic regulation of 5-hydroxymethylcytosine in mouse ES cells and during differentiation. Nature | vol. 473 | May 19, 2011. pp. 398-401. Macmillian Publishers.
Blelloch, Robert, et al. Generation of Induced Pluripotent Stem Cells in the Absence of Drug Selection. Sep. 13, 2007. pp. 245-247.
Verma, Sandeep et.al. Modified Oligonucleotides: Synthesis and Strategy for Users. Biochem. 1998. 67:99-134. 1998 by Annual Reviews.
Leung W. David. The Structure and Functions of Human Lysophosphatidic Acid Acyltransferases. Frontiers in Bioscience 6. pp. 944-953, Aug. 1, 2001.
Lu, Biao, et al. Cloning and characterization of murine 1-acyl-sn-glycerol 3-phosphate acyltransferases and their regulation by PPAR in murine heart. Biochem J. (2005) 385, 469-477 (printed in Great Britain).
West, James, et.al. Cloning and Expression of Two Human Lysophosphatidic Acid Acyltransferase cDNAs That Enhahce Cytokine-Induced Signialing Responses in Cells. DNA and Cell Biology vol. 16, No. 6, 1997. Mary Ann Liebert, Inc. pp. 691-791.
Bionaz, Massimo, et.al. ACSL1, AGPAT6, FABP3, LPIN1, and SLC27A6 are the Most Abundant Isoforms in Bovine Mammary Tissue and Their Expression is affected by Stage of Lactation. The Journal of Nutrition, 2008. pp. 1019-2024.
Sterner, D.E. et al., Acetylation of histones and transcription-related factors. Microbiol Mol Biol Rev. Jun. 2000;64(2):435-59.
Stiles, D.K., et al., Widespread suppresion of huntingtin with convection-enhanced delivery of siRNA. Experimental Neurology. Jan. 2012; 233(1): 463-471.
Stinchcomb, D.T. et al., Isolation and characterisation of a yeast chromosomal replicator. Nature. Nov. 1, 1979;282(5734):39-43.
Strong, V.T. et al., Incorporation of beta-globin untranslated regions into a Sindbis virus vector for augmentation of heterologous mRNA expression. Gene Ther. Jun. 1997;4(6):624-7.
Studier, F.W. et al., Use of bacteriophage T7 RNA polymerase to direct selective high-level expression of cloned genes. J Mol Biol. May 5, 1986;189(1):113-30.
Studier, F.W. et al., [6] Use of T7 RNA polymerase to direct expression of cloned genes. Methods Enzymol. 1990;185-60-89.
Su, Z. et al., Enhanced induction of telomerase-specific CD4(+) T Cells using dendritic cells transfected with RNA encoding a chimeric gene product. Cancer Res. Sep. 1, 2002;62(17):5041-8.
Su, Z. et al., Immunological and clinical responses in metastatic renal cancer ptaients vaccinated with tumor RNA-transfected dendritic cells. Cancer Res. May 1, 2003;63(9):2127-33.
Suda, T. et al., Hydrodynamic gene delivery: its principles and applications. Mol Ther. Dec. 2007;15(12):2063-9. Epub Oct. 2, 2007.
Sullenger, B.A. et al., Emerging clinical applications of RNA. Nature. Jul. 11, 2002;418(6894):252-8.
Svinarchuk, F.P. et al., Inhibition of HIV proliferation in MT-4 cells by antisense oligonucleotide conjugated to lipophilic groups. Biochimie. 1993;75(1-2):49-54.
Takahashi, K., et al., Induction of pluriopotent stem cells from mouse embryonic and adult fibroblast cultures by defined factors. Cell. Aug. 2006; 126(4): 663-76.
Takahashi, K., et al., Induction of pluripotent stem cells from adult human fibroblasts by defined factors. Cell. Nov. 2007; 131(5): 861-72.
Tam, C., et al., Cytokeratins mediate epithelial innate defense through their antimicrobial properties. J Clin Invest. Oct. 1, 2012; 122(10): 3665-3677.
Tanaka, M. et al., Inhibiton of heart transplant injury and graft coronary artery disease after prolonged organ ischemia by selective protein kinase C regulators. J Thorac Cardiovasc Surg. May 2005;129(6):1160-7.
Tang, D.C. et al., Genetic immunization is a simple method for eliciting an immune response. Nature. Mar. 12, 1992;356(6365):152-4.

Tanguay, R.L. et al., Translational efficiency is regulated by the length of the 3' untranslated region. Mol Cell Biol. Jan. 1996;16(1):146-56.
Taranger, C.K. et al., Induction of dedifferentiation, genomewide transcriptional programming, and epigenetic reprogramming by extracts of carcinoma and embryonic stem cells. Mol Biol Cell. Dec. 2005;16(12):5719-35.
Tavernier, G., et al., mRNA as gene therapeutic: How to control protein expression. J. of Controlled Release. Mar. 2011; 150(3): 238-247.
Tazi, J. et al., Alternative chromatin structure at CpG islands. Cell. Mar. 23, 1990;60(6):909-20.
Teufel, R. et al., Human peripheral blood mononuclear cells transfected with messenger RNA stimulate antigen-specific cytotoxic T-lymphocytes in vitro. Cell Mol Life Sci. Aug. 2005;62(15);1755-62.
Thompson, M. et al., Nucleolar clustering of dispersed tRNA genes. Science. Nov. 21, 2003;302(5649):1399-401.
Thurner, B. et al., Vaccination with mage-3A1 peptide-pulsed mature, monocyte-derived dendritic cells expands specific cytotoxic T cells and induces regression of some metastates in advanced stage IV melanoma. J Exp Med. Dec. 6, 1999;190(11):1669-78.
Tourriere, H. et al., mRNA degradation machines in eukaryotic cells. Biochimie. Aug. 2002;84(8):821-37.
Towle, H.C. et al., Purification and characterization of bacteriophage gh-l-induced deoxyribonucleic acid-dependent ribonucleic acid polymerase from Pseudomonas putida. J Biol Chem. Mar. 10, 1975;250(5):1723-33.
Treat, J. et al., In Liposomes in the Therapy of Infectious Disease and Cancer, Lopez-Berestein and Fidler (eds.), Liss, New York, 1989. 353-65.
Trinchieri, G. et al., Cooperation of Toll-like receptor signals in innate immune defence. Nat Rev Immunol. Mar. 2007;7(3):179-90.
Trojan, A. et al., Immune reactivity against a novel HLA-A3-restricted influenza virus peptide identified by predictive algorithms and interferon-gamma quantitative PCR. J Immunother. Jan.-Feb. 2003;26(1):41-6.
Tsuchiya, M, et al., Isolation and characterization of the cDNA for murine granulocyte colony-stimumating factor. Proc Natl Acad Sci USA. Oct. 1986; 83(20): 7633-7637.
Tung, T.C. et al., Organ formation caused by nucleic acid from different class.—Urodele DNA mediated balancer formation in goldfish. Sci Sin. Jan.-Feb. 1977;20(1):56-8.
Tung, T.C. et al., The effect of carp EGG-mRNA on the transformation of goldfish tail. Sci Sin. Jan.-Feb. 1977;20(1):59-63.
Tung, T.C. et al., Transmission of the nucleic acid-induced character, caudal fin, to the offspring in goldfish. Sci Sin. Mar.-Apr. 1975;18(2):223-31.
Tuting, T. et al., Gene-based strategies for the immunotherapy of cancer. J Mol Med (Berl). Jul. 1997;75(7):478-91.
Tycowski, K.T. et al., A small nucleolar RNA requirement for site-specific ribose methylation of rRNA in Xenopus. Proc Natl Acad Sci U S A. Dec. 10, 1996;93(25):14480-5.
Udenfriend, S., et al., The enzymatic conversion of phenylalanine to tyrosine. J. Biol. Chem. 1952; 194: 503-511.
Ueda, T. et al., Phosphorothioate-containing RNAs show mRNA activity in the prokaryotic translation systems in vitro. Nucleic Acids Res. Feb. 11, 1991;19(3):547-52.
Ulmer, J.B. et al., Heterologous protection against influenza by injection of DNA encoding a viral protein. Science. Mar. 19, 1993;259(5102):1745-9.
Ulmer, J.B., An update on the state of the art of DNA vaccines. Curr Opin Drug Discov Devel. Mar. 4, 2001(2);192-7.
Utikal, J., et al., Immortalization eliminates a roadblock during cellular reprogramming into iPS cells. Nature. Aug. 2009; 460: 1145-1148.
Uzgun, S., et al., PEGylation improves nanoparticle formation and transfection efficiency of messenger RNA. Pharm Res. Sep. 2011; 28(9): 2223-2232.
Uzri, D., et al., Nucleotide sequences and modifications that determine RIG-I/RNA binding and signaling activities. J. Virol. May 2009; 83 (9): 4174-4184.

(56) References Cited

OTHER PUBLICATIONS

Vaheri, A. and Pagano, J.S. Infectious poliovirus RNA: a sensitive method of assay. Virology. Nov. 1965; 27(3): 434-436.

Valcarcel, J. et al., The protein Sex-lethal antagonizes the splicing factor U2AF to regulate alternative splicing of transformer pre-mRNA. Nature. Mar. 11, 1993;362(6416):171-5.

Van Den Bosch, G.A., et al., Simultaneous activation of viral Antigen-specific Memory CD4+ and CD8+ T-cells using mRNA-eletroporated CD40-activated autologus B-cells. J Immunother. Sep./Oct. 2006; 29, 512-23.

Van Gelder, R.N. et al., Amplified RNA synthesized from limited quantities of heterogeneous cDNA. Proc Natl Acad Sci U S A. Mar. 1990;87(5):1663-7.

Van Tendeloo, V.F. et al., Highly efficient gene delivery by mRNA electroporation in human hematopoietic cells: superiority to lipofection and passive pulsing of mRNA and to electroporation of plasmid cDNA for tumor antigen loading of dendritic cells. Blood. Jul. 1, 2001;98(1):49-56.

Van Tendeloo, V.F., et al., mRNA-based gene transfer as a tool for gene and cell therapy. Curr Opin Mol Therapeutics. 2007; 9(5): 423-431.

Vaquero, C. et al., Transient expression of a tumor-specific single-chain fragment and a chimeric antibody in tobacco leaves. Proc Natl Acad Sci U S A,. Sep. 28, 1999;96(20):11128-33.

Varambally, S. et al., Genomic loss of microRNA-101 leads to overexpression of histone methyltransferase EZH2 in cancer. Science. Dec. 12, 2008;322(5908):1695-9. Epub Nov. 13, 2008.

Vassilev, V.B. et al., Microparticle-mediated RNA immunization against bovine viral diarrhea virus. Vaccine. Feb. 28, 2001;19(15-16):2012-9.

PCT Invitation to pay additional fees and, where applicable, protest fee for International application No. PCT/US2013/030061, dated Aug. 22, 2013.

Tripathy, Sandeep et al., Long-term expression of erythopoietin in the systemic circulation of mice after intramuscular injection of a plasmid DNA vector, Proc. Natl. Acad. Sci. USA 93, 1996, pp. 10670-10880.

Yarovoi, Helen, et al., Factor VIII ectopically expressed in platelets: efficacy in hemophilia A treatment, Blood Journal, Dec. 1, 2003, olume 102, No. 12, pp. 4005-4013.

PCT Invitation to pay additional fees and, where applicable, protest fee for International application No. PCT/US2013/030062, dated Jul. 19, 2013.

PCT Invitation to pay additional fees and, where applicable, protest fee for International application No. PCT/US2013/030064, dated Jul. 5, 2013.

Parker et al., Targeting of Polyelectrolyte RNA Complexes to Cell Surface Integrins as an Efficient, Cytoplasmic Transfection Mechanism, Journal of Bioactive and Compatible Polymers, Jul. 2002, pp. 1-10.

Kenneth Stanley, Design of Randomized Controlled Trials, Circulation, 2007; 115: pp. 1164-1169.

Chen XL, et al., Expression of human factor IX in retrovirus-transfected human umbilical cord tissue derived mesenchymal stem cells, PubMed, Feb. 2009; 17 (1): 184-87.

Cowling (Jan. 15, 2010, online Dec. 23, 2009, "Regulation of mRNA cap methylation," Biochemical Journal, 425 (Pt 2): 295-302.

Kozak, Marilyn, Regulation of translation via mRNA structure in prokaryotes and eukaryotes, Gene 361 (2005), pp. 13-37.

Fuke, Hiroyuki et al., Role of poly (A) tail as an identity element of mRna nuclear export, Nucleic Acids Research, 2008, vol. 36 No. 3, pp. 1037-1049.

Roger S. Riley, MD, Ph.D., Apr. 2005, http://www.pathology.vcu.edu/clinical/coag/FIX%20Deficiency.pdf, no volume, no pages, no publisher, no journal, 2 pages long.

SEQ Search Result 1(U.S. Appl. No. 13/897,362) dated Oct. 11, 2013.

Tracy, M., "Progress in the Development of LNP Delivery for siRNA Advancing LNPs to the Clinic," International Liposome Research Days Meeting, Vancouver, Canada. Aug. 2010, pp. 1-52.

International Search Report from International Application No. PCT/US2013/030064 dated Oct. 21, 2013.

International Search Report from International Application No. PCT/US2013/030062 dated Oct. 21, 2013.

International Search Report and Written Opinion from International Application No. PCT/US2011/54636 dated Apr. 17, 2013.

International Search Report for related application PCT/US2011/46861, Apr. 13, 2012.

International Preliminary Report on Patentability for related application PCT/US2012/031781, Oct. 1, 2013.

International Search Report and Written Opinion from International Application Serial No. PCT/US13/062943 dated Jan. 7, 2014.

Anderson, B.R., et al., Incorporation of pseudouridine into mRNA enhances translation by diminishing PKR activation, Nucleic Acids Res. vol. 38, No. 17, Sep. 1, 2010, pp. 5884-5892.

Kariko, K. et al , Generating the optimal mRNA for therapy: HPLC purification eliminates immune activation and improves translation of nucleoside-modified, protien-encoding mRNA. Nucleic Acids Res. vol. 39, No. 21, Nov. 1, 2011 pp. e142-1, XP002696190.

International Search Report and Written Opinion from International Application Serial No. PCT/US13/030067 dated Dec. 20, 2013.

International Search Report and Written Opinion from International Application Serial No. PCT/US13/030070 dated Dec. 23, 2013.

Love et al., Lipid-like materials for low-dose, in vivo genes silencing, PNAS vol. 107 No. 5, pp. 1864-1869, Feb. 2, 2010.

Mockey et al., mRNA-based cancer vaccine: prevention of B16 melanoma progression and metastasis by systemic injection of MART1 mRNA histidylated lipopolyplexes, Cancer Gene Therapy, 2001, 14, pp. 802-814.

Kwon et al. Molecular Basis for LDL receptor recognition by PCSK9. PNAS. 2008 105(6), 1820-1825.

Bates et al., Detection of Familial Hypercholesterolaemia: A Major Treatment Gap in Preventative Cardiology, Heart, Lung and Circulation 2008;17:411-413.

Garber et al.; A sensitive and convenient method for lipoprotein profile analysis of individual mouse plasma samples. Journal of Lipid Research. 2000. 14: 1020-1026.

Goldstein et al., History of Discovery: The LDL Receptor, Arterioscler Thromb Vasc Biol. Apr. 2009 ; 29(4): 431-438.

Hovingh et al., Diagnosis and treatment of familial hypercholesterolaemia, European Heart Journal (2013) 34, 962-971.

Kobayashi et al., Roles of the WHHL Rabbit in Translational Research on Hypercholesterolemia and Cardiovascular Diseases, Journal of Biomedicine and Biotechnology, vol. 2011, Article ID 406473, pp. 1-10.

Lambert et al., Thernatic Review Series: New Lipid and Lipoprotein Targets for the Treatment of Cardiometabolic Diseases The PCSK9 decade, Journal of Lipid Research vol. 53, 2012 pp. 2515-2524.

Lipari et al., Furin-cleaved Proprotein Convertase Subtilisin/Kexin Type 9 (PCSK9) is Active and Modulates Low Density Lopoprotein Receptor and Serum Cholesterol Levels. J Biol Chem. 2012, 287(52); 43482-43491.

Surdo et al., Mechanistic implications for LDLreceptor degradation from the PCSK9/LDLR structure at neutral pH, European Molecular Biology Organization, vol. 12 | No. 12 | 2011, pp. 1300-1130.

McNutt et al., Antagonism of Secreted PCSK9 Increases Low Density Lipoprotein Receptor Expression in HepG2 Cells. J Biol Chem. 2009. 284(16): 10561-10570.

Ni et al., A PCSK9-binding antibody that structurally mimics the EGF(A) domain of LDL-receptor reduces LDL cholesterol in vivo, Journal of Lipid Research vol. 52, 2011.

Rader et al., Monogenic hypercholesterolemia: new insights in pathogenesis and treatment, J. Clin. Invest. 111:1795-1803 (2003).

Stein et al., Effect of a Monoclonal Antibody of PCSK9 on LDL Cholesterol, N Engl J Med 2012;366:1108-18.

Watts et al., Familial hypercholesterolemia: a missed opportunity in preventive medicine, Nature Clinical Practice, Cardiovascular Medicine, Aug. 2007 , vol. 4, No. 8, pp. 404-405.

Zhang et al., Binding of Proprotein Convertase Subtilisin/Kexin Type 9 to Epidermal Growth Factor-like Repeat A of Low Density Lipoprotein Receptor Decreases Receptor Recycling and Increases Degradation, The Journal of Biological Chemistry, vol. 282, No. 25, pp. 18602-18612, Jun. 22, 2007.

(56) References Cited

OTHER PUBLICATIONS

Penheiter et al., Type II Transforming Growth Factor-β Receptor Recyclins is Dependent upon the Clathrin Adaptor Protein Dab2, Molecular Biology of the Cell, vol. 21, 4009-4019, Nov. 15, 2010.
Mulkearns et al., FCHO2 organizes clathrin-coated structures and interacts with Dab2 for LDLR endocytosis, Molecular Biology of the Cell, 2012, pp. 1-28.
Teckchandani et al., The clathrin adaptor Dab2 recruits EH domain scaffold proteins to regulate integrin β1 endocytosis, Molecular Biology of the Cell, 2012, pp. 1-28.
Stockinger et al., The PX-domain protein SNX17 interacts with members of the LDL receptor family and modulates endocytosis of the LDL receptor, European Molecular Biology Organization, vol. 21 No. 16 pp. 4259-4267.
Song et al., A putative role of micro RNA in regulation of cholesterol 7α-hydroxylase expression in human hepatocytes, Nature Biotechnol. 2005, 23:709-717.
Beigneux et al., Human CYP7A1 deficiency: progress and enigmas; The Journal of Clinical Investigation; Jul. 2002, vol. 110, No. 1, pp. 29-31.
Hofman et al., CYP7A1 A-278C Polymorphism Affects the Response of Plasma Lipids after Dietary Cholesterol or Cafestol Interventions in Humans, The Journal of Nutrition, 2004, pp. 2200-2204.
Pullinger et al., Human cholesterol 7α-hydroxylase (CYP7A1) deficiency has a hypercholesterolemic phenotype, J. Clin. Invest. 110:109-117 (2002).
Akinc et al., Targeted Delivery of RNAi Therapeutics With Endogenous and Exogenous Ligand-Based Mechanisms, Mol Ther. 2009 17:872-879.
Yamamoto et al., Current prospects for mRNA gene delivery, European Journal of Pharmaceutics and Biopharmaceutics 71 (2009) 484-489.
Trollet et al., Delivery of DNA into muscle for treating systemic diseases: advantages and challenges. Methods Mol. Biol. 2008., 423: 199-214.
Lorenzi, J.C., et al., Protein expression from exogenous mRNA: Uptake by receptor-mediated endocytosis and trafficking via the lysosomal pathway. RNA Biology, vol. 8, No. 4, Jul. 1, 2011, pp. 252-258.
International Search Report from International Application No. PCT/US13/54635 dated Mar. 3, 2014.
International Search Report from International Application No. PCT/US13/030070 dated Dec. 23, 2013.
Kassim et al., Gene Therapy in a humanized Mouse Model of Familial Hypercholesterolernia Leads to a Marked Regression of Atherosclerosis, PLOS ONE, Oct. 2010, vol. 5, Issue 10, pp. e13424.
Supplementary Data from Zhang et al., (J. Biol. Chem 282(25) 18602-12, 2007.
International Search Report from International Application No. PCT/US12/054574 dated Jul. 1, 2013.
NCBI BLAST (hyyp://blast.ncbi.nlm.nih.gov/Blast.cgi;accession No. BE136127, 2007.
Bell et al., Predisposition to Cancer Caused by Genetic and Functional Defects of Mammalian Atad5, PLOS Genetics, Aug. 2011, vol. 7, Issue 8, e1002245 pp. 1-15.
Gupta et al., Project Report Condon Optimization, 2003, pp. 1-13.
Whiteside, George, The Orgins and the future of microfluidics, Nature, vol. 442, Jul. 27, 2006 pp. 368-373.
Pridgen, et al.; Transepithelial Transport of Fc-Targeted Nanoparticles by the Neonatal Fc Receptor for Oral Delivery, Sci Translation Med., vol. 5, Issue 213, Nov. 27, 2013, pp. 1-8.
Nguyen, M. et al., Injectable Biodegradable Hydrogels, Macromolecular Bioscience, 2010,10, 563-579.
Morton, S. Scalable Manufacture of Built-to-Order Nanomedicine: Spray-Assisted Layer-by-Layer Functionalization of Print Nanoparticles, Advanced Materials, 2013, 25, 4708-4712.

Li, Z et al., Controlled Gene Delivery System Based pn Thermosensitive Biodegradeable Hydrogel, Pharmaceutical Research, vol. 20, No. 6, Jun. 2003.
Lee, et al.; Thermosensitive Hydrogel as a Tgf-β 1 Gene Delivery Vehicle Enhances Diabetic Wound Healing, Pharmaceutical Research, vol. 20, No. 12, Dec. 2003.
Cu, Y. et al., Enhanced Delivery and Potency of Self-Amplifying mRNA Caccines by Electroporation in Situ, Vaccines, 2013, 1, 367-383.
Chang, C. et al., Non-ionic amphiphilic biodegradable PEG-PLGA-PEG copolymer enhances gene delivery efficiency in rat skeletal muscle; Science Direct, Journal of Controlled Release 118 (2007) 245-253.
Nelson, C. et al., Tunable Delivery of SiRNA from a Biodegradable Scaffold to Promote Angiogenesis In Vivo, Advanced Materials, 2013, pp. 1-8.
Stroock, A. et al., Chaotic Mixer for Microchannels, Science, vol. 295, Jan. 25, 2002, pp. 1-6.
Zangi, L. et al., Modified mRNA directs the fate of heart progenitor cells and indices vasuclar regeneration after myocardial infarction, Nature Biology, Advanced Online Publication, May 10, 2013, pp. 1-9.
Valencia, P. et al., Microfluidic Platform for Combinatorial Synthesis and Optimization of Targeted Nanoparticles for Cancer Therapy, ACS Nano. Dec. 23, 2013; 7(12):10671-80.
Chen, Y., Self-assembled rosette nanotubes encapsulate and slowly release dexamethasone, International Journal of Nanomedicine, 2011:6 pp. 1035-1044.
Mitragotri, S.; Devices for Overcoming Biological Barriers: The use of physical forces to disrupt the barriers, Advance Drug Delivery Reviews, 65 (2013)100-103.
Wang, X.; Re-evaluating the Roles of Proposed Modulators of Mammalian Target of Rapamycin Complex 1 (mTORCl) Signaling,The Journal of Biological Chemistry, Nov. 7, 2008, vol. 283, No. 45, pp. 30482-30492.
Dreyer Hans C., Leucine-enriched essential amino acid and carbohydrate ingestion following resistance exercise ehances mTOR signaling and protein synthesis in human muscle, AM J. Physiol Endocrinol Metab,; 294; E392-E400,2008.
Lalatsa, Aikaterini, Amphiphilic poly (l-amino acids)—New materials for drug delivery. Journal of Controlled Release, 161 (2012) 523-536.
Stelic Institute & Co., Contract Research Services Specialized in NASH-HCC, Ver.2012.11, 2012, 99.1-10.
Limberis, M et al., Intranasal Antibody Gene Transfer in Mice and Ferrets Elicits Broad Protection Against Pandemic Influenza, Science Transl Med vol. 5, Issue 187, 99. 1-8.
Wei, et al., Induction of Broadly Neutralizing H1N1 Influenza Antibodies by Vaccination, Science vol. 329, (2010) pp. 1060-1064.
Palese, P., Making Better Influenza Virus Vaccines?, Emerging Infectious Diseases, vol. 12, No. 1, Jan. 2006, pp. 61-65.
Kwong, P et al., Broadly Neutralizing Antibodies and the Search for an HIV-1 Vaccine: The End of the Beginning, Nature Reviews, Immunology, vol. 13, Sep. 2013, pp. 693-701.
DeMarco, et al., A Non-VH1-69 Hetetrosubtypic Neutrilizing Human Minoclonal Antibody Protects Mice Against H1N1 and H5N1 Viruses, PLOS One, Apr. 2012, vol. 7, Issue 4, pp. 1-9.
Anderson, et al., The Bridge, National Academy of Engineering of the National Academies, Fall 2006, vol. 36., Nov. 3, pp. 1-55.
EP11830061, Supplementary Search Report, Mar. 18, 2014.
Iwase, Reiko et al., Molecular design of a eukaryotic messenger RNA and its chemical synthesis, Nucleic Acids Research, 1991, vol. 20, No. 7, pp. 1643-1648.
Squires, Jeffrey et al., Widespread occurrence of 5-methylcytosine in human coding an non-coding RNC, Nucleic Acids Research, 2012, vol. 40, No. 11, pp. 5023-5033.
Wyatt, et al., Occurrence of 5-Methyl-Cytosine in Nucleic Acid, 1950, vol. 166, No. 4214, pp. 237-238.
Chen, Chun et al., A Flexible RNA Backbone within the Polypyrimidine Tract Is Required for U2AF65 Binding and Pre-mRNA Splicing In Vivo, Molecular and Cellular Biology, 2010, vol. 30, No. 17, pp. 4108-4119.

(56) References Cited

OTHER PUBLICATIONS

Wantabe, Hiroshi, et al., Conformational Stability and Warfarin-Binding Properties of Human Serum Albumin Studied by Recombinany Mutants, Biochem. J., 2001, vol. 357, No number, pp. 269-274.
Abramova, Tatyana, Frontiers and Approaches to Chemical Synthesis of Oligodeoxyribonucleotides, Molecules 2013, vol. 57, No. 18, 1063-1075.
Bain, J.D. et al., Regioselective ligation of oligoribonucleotides using DNA Splints, Nucleic Acids Research, vol. 20, No. 16, p. 4372.
Bonora, G. et al., HELP (High Efficiency Liquid Phase) new oligonucleotide synthesis on soluble polymeric support, Oxford Journals Life Sciences Nucleic Acids Research vol. 18, Issue 11 pp. 3155-3159.
Borovkov, A. Et al., High-Quality Gene Assembly Directly From Unpurified Mixtures of Microarray-Synthesized Oligonucleotides, Nucleic Acids Research, 2010, vol. 38, No. 19, pp. e180 1-e180 10.
Cheng, S. et al. Effective Amplification of Long Targets From Cloned Inserts and Hunam Genomic DNA, Proc. Nati. Acad. Sci. USA, 1994, vol. 91, pp. 5695-5699.
Cleary, Michele et al., Production of Complex nucleic acid libraries using highly parallel in situ oligonucleotide synthesis, 2004, Nature Methods vol. 1 No. 3, Dec. 2004, pp. 241-248.
El-Sagheer, Afaf H. et al., Click Nucleic Acid Ligation: Applications in Biology and Nanotechnology, Accounts of Chemical Research, 2012 vol. 45, No. 8, pp. 1258-1267.
Freeman, Willard M. et al., Quantitative RT-PCR: Pitfalls and Potential, BioTechniques, 1999, vol. 26, No. 1, pp. 112-125.
Gibson, D. et al., Creation of a Bacterial Cell Controlled by a Chemically Synthesized Genome, Science, 2010, vol. 329, No. 52, pp. 51-56.
Gibson, Daniel G., Chemical Synthesis of the Mouse Mitochondrial Genome, Nature Methods , vol. 7., No. 11 Nov. 2010, pp. 901-905.
Goodchild, John et al., Conjugates of Oligonucleotides and Modified Oligonucleotides: A Review of Their Synthesis and Properties, Bioconjugate Chemistry, 1990, vol. 1., No. 3., pp. 165-187.
Innis, M., DNA Sequencing with Thermus Aquaticus DNA Polymerase and Direct Sequencing of Polymerase Chain Reaction-Amplified DNA, Proc. Natl. Acad. Sci. USA, 1988, vol. 85, pp. 9436-9440.
Kang, Hyunmin, Inhibition of MDR1 Gene Expression by Chimeric HNA Antisense Oligonucleotides, Nucleic Acids Research, 2004, vol. 32, No. 14, pp. 4411-4419.
Lavrik, Inna N. et al., Translational Properties of mHNA, a Messenger RNA Containing Anhydrohexitol Nucleotides, Biochemistry 2001, vol. 40, No. 39, pp. 11777-11784.
Li, Junjie, et al.; Methylation Protects miRNAs and siRNAs from a 3_-End Uridylation Activity in Arabidopsis, Current Biology, 2005, vol. 15, (no number), pp. 1501-1507.
Lizardi, PM., et al., Mutation Detection and Single-Molecule Counting Using Isothermal Rolling-Circle Amplification, Nat Genetics, 1998, vol. 19, No #, pp. 225-232.
Martinelli, Richard A., Chemiluminescent Hybridization-Ligation Assays for F508 and I507 Cystic Fibrosis Mutations, Clinical Chemistry, 1996, vol. 42., No. 1, pp. 14-18.
Moore, M., Site-Specific Modification of Pre-mRNA: The 2"-Hydroxyl Groups at the Splice Sites, Science, 1992, vol. 256, No #, pp. 992-997.
Nagata, S., Synthesis and Biological Activity of Artificial mRNA Prepared with Novel Phosphorylating Reagents, Nucleic Acids Research, 2010, vol. 38, No. 21, pp. 7845-7857.
Norbury, Chris J., Cytoplasmic RNA: A Case of the Tail Wagging the Dog, Nature Reviews, Molecular Cell Biology, 2013, Advanced Online Publication, No Volume Number, pp. 1-10.
Nwe, K. et al., Growing Applications of "Click Chemistry" for Bioconjugation in Contemporary Biomedical Research, Cancer Biotherapy and Radiopharmaceuticals, 2009, vol. 24, No. 3., pp. 289-301.
Ochman, H., Genetic Applications of an Inverse Polymerase Chain Reaction, Genetics, Washington University School of Medicine, 1988, vol. 120, No #, pp. 621-623.
Polidoros, A. et al., Rolling Circle Amplification—RACE: a method for Simultaneous Isolation of 5" and 3" cDNA ends from Amplified cDNA templates, Benchmarks, Biotechniques, 2006, vol. 41, No. 1, pp. 35-42.
Pon, R., Multiple Oligodeoxyribonucleotide Syntheses on a Reusable Solid-Phase CPG Support Via the Hydroquinone-O, O"-diacetic acid (Q-Linker) linker arm, Nucleic Acids Research, 1999, vol. 27, No. 6, pp. 1531-1538.
Shiba, Y. et al., Chemical Synthesis of a Very Long Oligoribonucleotide with a 2-cyanoethoxymethyl (CEM) as the 2'-O-protecting Group: Structural Identification and Biological Activity of a Synthetic 110mer precursor-microRNA Candidate, Nucleic Acids Research, 2007, vol. 35, No. 10, pp. 3287-3296.
Sindelar, L. et al., High-throughput DNA Synthesis in a Multichannel Format, Nucl. Acids Res. 1995, vol. 23, No. 6, pp. 982-987.
Stark, M. et al., An RNA Ligase-mediated Method for the Efficient Creation of Large, Synthetic RNAs, Method, 2006, vol. 12, No Vol. number, pp. 2014-2019.
Walker, T., Isothermal In Vitro Amplification of DNA by a Restriction Enzyme/ DNA Polymerase System, Proc. Natl. Acad. Sci. USA, 1992, vol. 89, No number, pp. 392-396.
Zhu, B., Syn5 RNA Polymerase Synthesizes Precise Run-Off RNA Products, Nucleic Acids Research, 2013, vol. 103, No #, pp. 1-10.
Prokazyme Ltd., ThermoPhage, ssDNA ligase,2013, No Vol. pp. 1-3.
Prokaria Ltd, Tsc DNA ligase, 2013, No Vol., pp. 1-3.
Bolhassani A., et al. , Improvement of Different Vaccine Delivery Systems for Cancer Therapy, Molecular Cancer, Biomed Central, London, GB, 2011, vol. 10, No. 3, pp. 1-20.
Cheng, Ee-chun et al., Repressing the Repressor: A lincRNA as a MicroRNA Sponge in Embryonic Stem Cell Self-Renewal, Developmental Cell, 2013, vol. 25, No number, pp. 1-2.
Memczak, Sebastian et al. , Circular RNAs are a large class of animal RNAs with Regulatory Potency, Nature, 2013, vol. 495, no number, pp. 333-343.
Hentze, M., Circular RNAs: Splicing's Enigma Variations, The EMBO Journal, 2013, vol. 32, no number, pp. 923-925.
Ledford, Heidi et al, Circular RNAs Throw Genetics for a Loop, In Focus News, Nature, vol. 494, pp. 291-292.
Salzman, Julia et al., Circular RNAs Are the Predominant Transcript Isoform From Hundreds of Human Genes in Diverse Cell Types, PLOS One, 2012, vol. 7, Issue 2, pp. 1-12.
Ebert, Margaret S., MicroRNA sponges: Competitive Inhibitors of Small RNAs in Mammalian Cells, Nature Methods, 2007, vol. 4, No. 9, pp. 721-726.
Jeck, William et al. Circular RNAs Are Abundant, Conserved, and Associated with ALU Repeats, RNA, 2013, vol. 19, pp. 141-157.
Matsuda, V. et al., Determinants of Initiation Codon Selection During Translation in Mammalian Cells, PLOS One, 2010, vol. 5, Issue 11, pp. 1-13.
Mukherji, S. et al., MicroRNAs Can Generate Thresholds in Target Gene Expression, Nature Genetics, 2011, vol. 43, No. 9, pp. 854-860.
Hansen, Thomas et al., Natural RNA Circles Function As Efficient MicroRNA Sponges, Nature, 2013, vol. 495, no number, pp. 384-390.
Rose, Jason, MicroRNA "Sponge": Proof of Concept for a Novel MicroRNA Target Identification Technique, A Major Qualifying Project Report, Submitted to the Faculty of Worcester Polytechnic Institute, 2010, No Volume, pp. 1-26.
Touriol, C. et al., Generation of Protein Isoform Diversity by Alternative Initiation of Translation At Non-AUG Codons, Biology of the Cell, 2003, vol. 95, no number, pp. 168-178.
Wang et al., Endogenous miRNA Sponge lincRNA-RoR Regulates Oct4, Nanog, and Sox2 in Human Embryonic Stem Cell Self-Renewal, Developmental Cell, 2013, vol. 25, No #, pp. 69-80.
Goldberg, I.H. et al., The incorporation of 5-ribosyluracil triphosphate into RNA in nuclear extracts of mammalian cells. Biochemical Biophysical Research Communications. 1961; 6(5): 394-398.

(56) References Cited

OTHER PUBLICATIONS

Goldberg, I.H. et al., Comparative utilization of pseudouridine triphosphate and uridine triphosphate by ribonucleic acid polymerase. J Biological Chem. May 1963; 238(5): 1793-1800.

Gordon, S.N. et al., Targeting the vaginal mucosa with human papillomavirus pseudovirion vaccines delivering SIV DNA. J Immunol. Jan. 15, 2012; 188(2): 714-723.

Grabbe, S. et al., Dendritic cells as initiators of tumor immune responses: a possible strategy for tumor immunotherapy? Immunol Today. Mar. 1995;16(3):117-21.

Grabbe, S. et al., Tumor antigen presentation by epidermal antigen-presenting cells in the mouse: modulation by granulocyte-macrophage colony-stimulating factor, tumor necrosis factor alpha, and ultraviolet radiation. J Leukoc Biol. Aug. 1992;52(2):209-17.

Grabbe, S. et al., Tumor antigen presentation by murine epidermal cells. J Immunol. May 15, 1991;146(10):3656-61.

Graf, M. et al., Codon-optimized genes that enable increased heterologous expression in mammalian cells and elicit efficient immune responses in mice after vaccination of naked DNA. Methods Mol Med. 2004;94:197-210.

Graham, F.L., et al., A new technique for the assay of infectivity of human adenovirus 5 DNA. Virology. Apr. 1973;52(2):456-67.

Gram, G.J. et al., Immunological analysis of a Lactococcus lactis-based DNA vaccine expressing HIV gp120. Genet Vaccines Ther. Jan. 29, 2007;5:3.

Granstein, R.D. et al., Induction of anti-tumor immunity with epidermal cells pulsed with tumor-derived RNA or intradermal administration of RNA. J Invest Dermatol. Apr. 2000;114(4):632-6.

Greenblatt, M.S. et al., Mutations in the p53 tumor suppressor gene: clues to cancer etiology and molecular pathogenesis. Cancer Res. Sep. 15, 1994;54(18):4855-78.

Grentzmann, G. et al., A dual-luciferase reporter system for studying recoding signals. RNA. Apr. 1998;4(4):479-86.

Grosjean, H., Modification and editing of RNA: historical overview and important facts to remember. Fine-tuning of RNA functions by modification and editing. Topics Curr Gen. Jan. 2005; 12: 1-22.

Gross, G. et al., Heterologous expression as a tool for gene identification and analysis. J Biol Chem. Jul. 31, 1995;41(2):91-110.

Grudzien, E. et al., Novel cap analogs for in vitro synthesis of mRNAs with high translational efficiency. RNA. Sep. 2004;10(9):1479-87.

Grudzien-Nogalska, E. et al., Phosphorothioate cap analogs stabilize mRNA and increase translational efficiency in mammalian cells. RNA. Oct. 2007;13(10):1745-55. Epub Aug. 24, 2007.

Gryaznov, S.M., Oligonucleotide N3'→P5'phosphoramidates as potential therapeutic agents. Biochim Biophys Acta. Dec. 10, 1999;1489(1):131-40.

Guhaniyogi, J. et al., Regulation of mRNA stability in mammalian cells. Gene. Mar. 7, 2001;265(1-2):11-23.

Guo, L. et al., Structure and function of a cap-independent translation element that functions in either the 3' or the 5' untranslated region. RNA. Dec. 2000;6(12):1808-20.

Haas, J. et al., Codon usage limitation in the expression of HIV-1 envelope glycoprotein. Curr Biol. Mar. 1, 1996;6(3):315-24.

Hakelien, A.M., et al., Novel approaches to transdifferentiation. Cloning Stem Cells. 2002;4(4):379-87.

Hakelien, A.M., Reprogramming fibroblasts to express T-cell functions using cell extracts. Nat Biotechnol. May 2002;20(5):460-6.

Hambraeus, G. et al., A 5' stem-loop and ribosome binding but not translation are important for the stability of Bacillus subtilis aprE leader mRNA. Microbiology. Jun. 2002;148(Pt 6):1795-803.

Hancock, J.F., Reticulocyte lysate assay for in vitro translation and posttranslational modification of Ras proteins. Methods Enzymol. 1995;255:60-5.

Hannon, G.J. et al., Trans splicing of nematode pre-messenger RNA in vitro. Cell. Jun. 29, 1990;61(7):1247-55.

Harel, J ., Action of polyribonucleotides, extracted by the phenol method, on the growth of mouse tumor cells. C.R. Hebd Seances Acad. Sci., 1962, 254:4390-2.

Harris, J. et al., An improved RNA amplification procedure results in increased yield of autologous RNA transfected dendritic cell-based vaccine. Biochim Biophys Acta. Jun. 20, 2005;1724(1-2):127-36. Epub Apr. 7, 2005.

Hausmann, R., Bacteriophage T7 genetics. Curr Top Microbiol Immunol. 1976;75:77-110.

Hays, E.F. et al., Induction of mouse leukaemia with purified nucleic acid preparations. Nature. Dec. 21, 1957;180(4599):1419-20.

He, K. et al., Synthesis and Separation of Diastereomers of Ribonucleoside 5'-(alpha-P-Borano)triphosphates. J Org Chem. Aug. 21, 1998;63(17):5769-5773.

Hecker, J.G. et al., Non-Viral DNA and mRNA Gene Delivery to the CNS Pre-Operatively for Neuroprotection and Following Neurotrauma. Molecular Therapy. 2004; 9, S258-S258.

Hedman, M, et al., Safety and feasibility of catheter-based local intracoronary vascular endothelial growth factor gene transfer in the prevention of postangioplasty and in-stent restenosis and in the treatment of chronic myocardial ischemia: phase II results of the Kuopio Angiogenesis Trial (KAT). Circulation. Jun. 3, 2003; 107(21): 2677-83. Epub May 12, 2003.

Heidenreich, O. et al., Chemically modified RNA: approaches and applications. FASEB J. Jan. 1993;7(1):90-6.

Heidenreich, O. et al., High activity and stability of hammerhead ribozymes containing 2'-modified pyrimidine nucleosides and phosphorothioates. J Biol Chem. Jan. 21, 1994;269(3):2131-8.

Heil, F. et al., Species-specific recognition of single-stranded RNA via toll-like receptor 7 and 8. Science. Mar. 5, 2004;303(5663):1526-9. Epub Feb. 19, 2004.

Heilman, K.L. et al., Internal 6-methyladenine residues increase the in vitro translation efficiency of dihydrofolate reductase messenger RNA. Int J Biochem Cell Biol. Jul. 1996; 28(7): 823-829.

Heiser, A. et al., Autologous dendritic cells transfected with prostate-specific antigen RNA stimulate CTL responses against metastatic prostate tumors. J Clin Invest. Feb. 2002;109(3):409-17.

Heiser, A. et al., Human dendritic cells transfected with renal tumor RNA stimulate polyclonal T-cell responses against antigens expressed by primary and metastatic tumors. Cancer Res. Apr. 15, 2001;61(8):3388-93.

Heiser, A. et al., Human dendritic cells transfected with RNA encoding prostate-specific antigen stimulate prostate-specific CTL responses in vitro. J Immunol. May 15, 2000;164(10):5508-14.

Heiser, A. et al., Induction of polyclonal prostate cancer-specific CTL using dendritic cells transfected with amplified tumor RNA. J Immunol. Mar. 1, 2001;166(5):2953-60.

Helbock, H.J. et al. N2-methyl-8-oxoguanine: a tRNA urinary metabolite—role of xanthine oxidase. Free Radic Biol Med. 1996;20(3):475-81.

Hemmi, H. et al, A Toll-like receptor recognizes bacterial DNA. Nature. Dec. 7, 2000;408(6813):740-5.

Herweijer, H. et al., Gene therapy progress and prospects: hydrodynamic gene delivery. Gene Ther. Jan. 2007;14(2):99-107. Epub Nov. 30, 2006.

Hess, M. et al., The effects of nucleic acids on pituitary ACTH content. Endocrinology. Mar. 1961;68:548-52.

Higman, M.A. et al., The mRNA (guanine-7-)methyltransferase domain of the vaccinia virus mRNA capping enzyme. Expression in *Escherichia coli* and structural and kinetic comparison to the intact capping enzyme. J Biol Chem. May 27, 1994;269(21):14974-81.

Higman, M.A. et al., The vaccinia virus mRNA (guanine-N7-)-methyltransferase requires both subunits of the mRNA capping enzyme for activity. J Biol Chem. Aug. 15, 1992;267(23):16430-7.

Hilleren, P. et al., Mechanisms of mRNA surveillance in eukaryotes. Annu Rev Genet. 1999;33:229-60.

Hillman, N.W. et al., Chick Cephalogenesis, I. The Effect of RNA on Early Cephalic Development. PNAS, 1963, 50:486-93.

Ho, CS., et al., Electrospray ionisation mass spectrometry: Principles and clinical applications. Clin Biochem Rev. Feb. 2003; 24: 3-12.

Hoath, S.B. et al., The organization of human epidermis: functional epidermal units and phi proportionality. J Invest Dermatol. Dec. 2003;121(6):1440-6.

WHO Drug Information, International Nonproprietary Names for Pharmaceutical Substances (INN), 1993, vol. 7, No. 4, pp. 1-16.

(56) References Cited

OTHER PUBLICATIONS

Eli Lilly and Company, ReoPRo, Abciximab, Product Label, 2005, No volume number, pp. 1-4.
Kempeni, Joachim et al., Preliminary Results of Early Clinical Trials with the Fully Human Anti-TNFa Monoclonal Antibody D2E7, Ann Rheum Dis, 1999, vol. 58, Supp I, pp. 170-172.
Lindner, Heidrun et al., Peripheral Blood Mononuclear Cells Induce Programmed Cell Death in Human Endothelial Cells and May Prevent Repair: Role of Cytokines, 1997, vol. 89, No. 6, pp. 1931-1938.
Crowe, J.S. et al., Humanized Monoclonal Antibody CAMPATH-1H Myeloma Cell Expression of Genomic Constructs, Nucleotide Sequence of cDNA Constructs and Comparison of Effector Mechanisms of Myeloma and Chinese Hamster Ovary Cell-Derived Material, Clinical Exp. Immunol., 1992, vol. 87, No number, pp. 105-110.
Ferrara, James et al., Graft-versus Host Disease, Lancet, 2009, vol. 373, No. 9674, pp. 1550-1561.
Hale, G. et al., Removal of T Cells From Bone Marrow for Transplantation: a Monoclonal Antilyphocyte Antibody That Fixes Human Complement, Blood, 1983, vol. 62, No. 4, pp. 873-882.
Lutz, Riechmann et al., Reshaping Human Antibodies for Therapy, Nature,1988, vol. 332, No. 24 , pp. 323-327.
Novartis, Product Label, Simulect, Basiliximab, 1998, No Vol. pp. 1-7.
Baker, Kevin P. et al., Generation and Charaterization of LymphonStat-B, a Human Monoclonal Antibody That Antagonizes the Bioactivities of B Lymphocyte Stimulator, Arthritis & Rheumatism, 2003, vol. 48, No. 11, pp. 3253-3265.
ADIS R&D Profile, Belimumab, Drugs R D, 2010; vol. 10 , No. 1, pp. 55-65.
Avastin, Bevacizumab, Labeling Text, 2013, No Volume, pp. 1-27.
Chen, Helen et al., Expanding the Clinical Development of Bevacizumab, The Oncologist, 2004, vol. 9, Supp 1, pp. 27-35.
Herbst, Roy et al., Non-Small Cell Lung Cancer and Antiangiogenic Therapy: What Can Be Expected pf Bevacizumab?, The Oncologist, 2004, vol. 9 Supp. 1, pp. 19-26.
Presta, Leonard G. et al., Humanization of Anti-Vascular Endothelial Growth Factor Monoclonal Antibody for the Therapy of Solid Tumors and Other Disorders, Cancer Research, 1997, vol. 57, pp. 4593-4599.
Bowen, Michael et al., Functional Effects of CD30 on a Large Granular Lymphoma Cell Line, YT, The Journal of Immunology, 1993, vol. 151, No. 11, pp. 1-11.
ADCETRIS, brentuximab vedotin, Product Label, 2011,No Volume, pp. 1-15.
Francisco, Joseph et al., cAc10-vcMMAE, an Anti-CD30-monomethyl Auristatin E Conjugate with Potent and Selective Antitumor Activity, Blood, 2003,vol. 102, No. 4, pp. 1458-1465.
Wahl, Alan F. et al, The Anti-CD30 Monoclonal Antibody SGN-30 Promotes Growth Arrest and DNA Fragmentation in Vitro and Affects Antitumor Activity in Models of Hodgkins's Disease, Cancer Research, 2002, vol. 62, pp. 3737-3742.
Alten, Rieke et al., The Human Anti-IL-1β Monoclonal Antibody ACZ885 is Effective in Joint Inflammation Models in Mice and In a Proof-of-Concept Study in Patients with Rheumatoid Arthritis, Arthritis Research & Therapy, 2008, vol. 10, No. 3, pp. 1-9.
Canakinumab FDA Label, 2009, No Volume # pp. 1-11.
Church, L et al. , Canakinumab, a Fully Human mAB Against IL-1β for the Potential Treatment of Inflammatory Disorder, Current Opinion in Molecular Therapeutics, 2009, vol. 11, No. 1, pp. 81-89.
Lachmann, Helen et al., In Vivo Regulation of Interleukin 1β in Patients With Cryopyrin-Associated Periodic Syndromes, The Journal of Experimental Medicine, 2008, vol. 206, No. 5, pp. 1029-1036.
Lachmann, Helen et al., Use of Canakinumab in the Cryopyrin-Associated Periodic Syndrome, The New England Journal of Medicine, 2009, vol. 360, No. 23, pp. 2416-2425.
Rowe, William S. et al., Update on the Pathogenesis and Treatment of Systemic Idiopathic Arthritis, Curr. Opinion Pediat, 2011, vol. 23, No. 6, pp. 640-646.
Wells, Michael J. et al,. Pathophysiology and Clinical Implications of Pulmonary Arterial Enlargement in COPD, International Journal of COPD, 2013, vol. 8, No number, pp. 509-521.
ImClone Systems Incorporated and Bristol-Myers Squibb Company, ERBITUX, Cetuximab, 2004, No Vol number, pp. 1-18.
Goldstein, N et al., Biological Efficacy of a Chimeric Antibody to the Epidermal Growth Factor Receptor in a Human Tumor Xenograft Model, Clinical Cancer Research, 1995, vol. 1, No number, pp. 1311-1318.
Mendelsohn, J. et al, Epidermal Growth Factor Receptor Inhibition by a Monoclonal Antibody as Anticancer Therapy, 1997, vol. 3 No #, pp. 2703-2707.
Xiang, Bo et al., Colorectal Cancer Immunotherapy, Discovery Medicine, 2013, No Vol., pp. 1-8.
Chapman, Andrew et al., Therapeutic Antibody Fragments With Prolonged in Vivo Half-Lives, Nature America Inc., 1999, vol. 17, No Number, pp. 780-783.
Choy et al, Efficacy of a Novel PEGylated Humanized Anti-TNF Fragment (CDP870) in patients with Rheumatoid Arthritis: A phase II double-blinded, randomized, Dose-Escalating Trial, Rheumatology 2002; vol. 41, No number, pp. 1133-1137.
CIMZIA, Product Label, Reference ID: 3217327, UCB, Inc., 2008, No. Vol #, pp. 1-26.
Goel, N. et al, Certolizumab pegol, mABS, 2010, vol. 2, No. 2, pp. 137-147.
Mease, PJ et al., Effect of certolizumab pegol on signs and symptoms in patients with psoriatic arthritis: 24-week results of a Phase 3 double-blind randomized placebo-controlled study (RAPID-PsA), Ann Rheum Dis, 2014, vol. 73, No #, pp. 48-55.
Queen, C et al., A humanized antibody that binds to the interleukin 2 receptor, Proc. Natl. Acad. Sci. USA, 1989, vol. 86, pp. 10029-10033.
Jaffers, Gregory et al, Monoclonal Antibody Therapy, Transplantation, 1986, vol. 41, No. 5, pp. 572-578.
Ortho Multicenter Transplant Study Group, A Randomized Clinical Trial of OKT3 Monoclonal Antibody for Acute Rejection of Cadaveric Renal Transplants, The New England Journal of Medicine, 1985, vol. 313, No. 6, pp. 337-342.
Roche, Zenapax (daclizumabl) Sterile Concentrate for Injection,2013, No Vol., pp. 1-11.
Bekker, Pirow et al., The Effect of a Single Dose of Osteoprotegerin in Postmenopausal Women, Journal of Bone and Mineral Research, 2001, vol. 16, No. 2, pp. 1-13.
Bekker, Prow et al., A single-Dose Placebo-Controlled Study of AMG 162, a Fully Human Monoclonal Antibody to RANKL, in Postmenopausal Women, Journal of Bone and Mineral Research, 2004, vol. 19, No. 7, pp. 1-8.
Body, Jean-Jacques et al., A Study of the Biological Receptor Activator of nuclear Factor-KappaB Ligand inhibitor, Denosumab, in patients with multiple myeloma or bone metastases from Breast Cancer, Clinical Cancer Research, 2006, vol. 12, No #, pp. 1221-1228.
Westenfeld, Ralf et al., Anti-RANKL therapy—implications for the bone-vascular-axis in CKD? Denosumab in post-menopausal women with low bone mineral density, Nephrol Dial Transplant, 2006, vol. 21, pp. 2075-2077.
Xgeva (denosumab) Product Label 2010-2013 pp. 1-16.
Hillmen, Peter et al., Effect of Eculizumab on Hemolysis and Transfusion Requirements in Patients with Paroxysmal Nocturnal Hemoglobinuria, The New England Journal of Medicine, 2004, vol. 350, No. 6, pp. 552-559.
Ministry of Health, Labour and Welfare, Report on the Deliberation Results, Soliris for Intravenous Infusion 300 mg, 2010, No Vol., pp. 1-105.
Golimumbab—Product Label—Janssen Biotech, Inc., 2013, No Volume number, pp. 1-19.
Garcia, Maria et al., Patient Consideration in the Management of Rheumatoid Arthritis: Role of Once-A-Month Golimumab Injection, Clinical Medical Insights: Therapeutics, Libertas Academica, 2011, vol. 3, No #, pp. 415-423.

(56) References Cited

OTHER PUBLICATIONS

Mazumdar, Sohini et al., Golimumab, mAbs, 2009, vol. 1, No. 5, pp. 422-431.
Shealy, David et al., Characterization of Golimumab, A Human Antibody Specific for Human Tumor Necrosis Factor α, mAbs, 2010, vol. No. 2, No. 4, pp. 428-439.
Hainsworth, John, Monoclonal Antibody Therapy in Lymphoid Malignancies, The Oncologist, 2000, vol. 5, No #, pp. 376-384.
FDA Label, Ibritumomab Tiuxetan, ZEVALIN, 2001, IDEC Pharmaceuticals Corporation, No Vol. pp. 1-38.
Wagner, Henry et al., Admiration Guidelines for Radioimmunotherapy of Non-Hodgkin's Lymphoma with 90Y-Labeled Anti-CD20 Monoclonal Antibody, 90Y Radioimmunotherapy Administration, The Journal of Nuclear Medicine, 2002, vol. 43, No. 2, pp. 267-272.
Who Drug Information, International Nonproprietary Names for Pharmaceutical Substances (INN), Recommended INN, 2000, vol. 14, No. 1, pp. 39-76.
Fellner, Christopher et al., Ipilimumab (Yervoy) Prolongs Survival in Advanced Melanoma, Drug Forecast, 2012, vol. 37, No. 9, pp. 503-530.
Hooks, Michael et al., Muromonab CD-3: A Review of Its Pharmacology, Pharmacokinetics, and Clinical Use in Transplantation, Pharmacotherapy, 1991, vol. 11, No. 1, pp. 26-37.
FDA Guide, TYSABRI, Elan Pharmaceuticals, Inc., Reference ID: 3308057, Biogen Idec, Inc. 2013, No Volume #, pp. 1-6.
Gordon, F.H., A Pilot Study of Treatment of Active Ulcerative Colitis With Natalizumab, a Humanized Monoclonal Antibody to Alpha-4 Integrin, Aliment Pharacol Ther, 2002, vol. 16, No #, pp. 699-705.
Guagnozzi, Danila etal, Natalizumab in the Treatment of Crohn's Disease, Biologics: Targets & Therapy, vol. 2, No. 2, pp. 275-284.
Nicholas, J et al., New and Emerging Disease-Modifying Therapies for Relapsing-Remitting Multiple Sclerosis: What is New and What is to Come, Journal of Central Nervous System Disease, 2012, vol. 4, No#, pp. 81-103.
Minagar, Alireza et al., Current and Future Therapies for Multiple Sclerosis, Scientifica, 2012, vol. 2013, Artible ID 249101, pp. 1-11.
Cong, Shundong et al., Novel CD20 Monoclonal Antibodies for Lymphoma Therapy, Journal of Hematology & Oncology, 2012, vol. 5, No. 64, pp. 1-9.
FDA Label, ARZERRA, Prescribing Info, 2009, GlaxoSmithKline, No. Vol., pp. 1-13.
Issa, Ghayas et al., Movel Agents in Waldenstrom Macroglobulinemia, Clin Investig, 2011, vol. 1, No. 6, pp. 815-824.
Jaglowski, Samantha et al., The clinical application of monoclonal antibodies in chronic lymphocytic leukemia, Blood, 2010, vol. 116, No #, pp. 3705-3714.
Rosman, Ziv et al., Biologic Therapy for Autoimmune Diseases: an update, BMC Medicine, 2013, vol. 11 No. 88 pp. 1-12.
Teeling, Jessica et al., Characterization of New Human CD20 Monoclonal Antibodies with Potent Cytolytic Activity Against Non-Hodgkin Lymphomas, Blood, 2004, vol. 104, No#, pp. 1793-1800.
Teeling, Jessica et al., The Biological Activity of Human CD20 Monoclonal Antibodies Is Linked to Unique Epitopes on CD20, The Journal of Immunology, 2006, vol. 177, No #, pp. 362-371.
Zhang, Bodi et al., Ofatumumab, mAbs, 2009, vol. 1, No. 4, pp. 326-331.
Vichyanond, Pakit et al., Omalizumab in allergic diseases, a recent review, Asian Pac J Allergy Immunol, 2011, vol. 29, No #, pp. 209-219.
Thomson, Neil et al, Circulatory, Respiratory and Pulmonary Medicine, Clinical Medicine Insights, 2012, vol. 6, No #, pp. 27-40.
FDA, Medication Guide Xolair, (omalizumab), 2013, No Vol. pp. 1-2.
Biopharma, Sample Synagis, MedImmune, Inc., 2013, No Vol. pp. 1-19.
FDA Label—SYNAGIS® (PALIVIZUMAB)—1999, MedImmune, Inc., No. Vol. pp. 1-7.

Huang, Kelly et al., Respiratory Syncytial Virus-Neutralizing Monoclonal Antibodies Motavizumab and Palivizumab Inhibit Fusion, Journal of Virology, Aug. 2010, vol. 84, No. 16, pp. 8132-8140.
FDA Label—Vectibix® (panitumumab), Amgen Inc., 2006-2008, No Vol. , pp. 1-13.
Grunwalk, Viktor et al., Developing Inhibitors of the Epidermal Growth Factor Receptor for Cancer Treatment, Journal of the National Cancer Institute, 2003, vol. 95, No. 12, pp. 851-867.
Yang, Xiao-Dong et al., Eradication of Established Tumors by a Fully Human Monoclonal Antibody to the Epidermal Growth Factor Receptor without Concomitant chemotherapy, Cancer Research, 1999, vol. 59, No. #, pp. 1236-1243.
Yang, Xiao-Dong et al., Development of ABX-EGF, A Fully Human anti-EGF Receptor Monoclonal Antibody, for Cancer Therapy, Oncology Hematology, 2001, vol. 38, No. #, pp. 17-23.
FDA, Highlights of Prescribing Information LUCENTIS(ranibizumab injection), Genentech, Inc., 2006, No Vol., pp. 1-9.
Binder, Mascha et al., The Epitope Recognized by Rituximab, Blood, 2006, vol. 108, No. 6, pp. 1975-1978.
FDA Label, Rituxan, Rituximab, IDEC Pharmaceuticals Corporation and Genetech, Inc., No Vol #, pp. 1-2.
FDA Label, ACTEMRA (tocilizumab) , Risk Evaluation and Mitigation Strategy (REMS) 2013, Genentech, Inc., Reference ID: 3394610, No Vol. #, pp. 1-53.
FDA Label, BEXXAR, Tositumomab and Iodine I 131 Tositumomab 2003, Corixa Corp. and GlaxoSmithKline, No Vol #, pp. 1-49.
Srinivasan, A. et al., Tositumomab and Iodine I 131 Tositumomab Bexaar, Pharmacology Vignette, 2011, vol. 32 , No #, pp. 637-638.
FDA Guide, HERCEPTIN (trastuzumab), Highlights of Prescribing Information, 2010, Genentech, Inc., pp. 1-33.
European Public Assessment Report (EPAR), REMOVAB, European Medicines Agency, 2009, No Vol. #pp. 1-2.
Ruf, P. et al., Characterization of the New EpCAM-specific antibody HO-3: Implications for Trifunctional Antibody Immunotherapy of Cancer, British Journal of Cancer, 2007, vol. 97, No. 3, pp. 351 321.
Chelius, Dirk et al., Structural and functional characterization of the trifunctional antibody catumaxomab, mAbs, 2010, vol. 2 No. 3, pp. 309-319.
Linke, Rolf et al., Catumazomab Clinical Development and Future Directions, Landes Bioscience, mAbs, vol. 2, No. 2, pp. 129-136.
McLean, Leon et al., Vedolizumab for the treatment of ulcerative colitis and Crohn's disease, Immunotherapy, 2012, vol. 4, No. 9, pp. 883-898.
Reichert, Janice M. et al., Which Are the Antibodies to Watch in 2013, mAbs, 2013, vol. 5, No. 1, pp. 1-4.
Rob C. et al., IgG4 Breaking the Rules, Immunology, 2002, vol. 105, No #, pp. 9-19.
Alexandrakis, Michael et al., Relationship Between Circulating BAFF Serum Levels with Proliferating Markers in Patients with Multiple Myeloma, Biomed Research International, 2013, vol. 2013, Article ID. 389579, pp. 1-7.
Alfonso, Mauro et al., An Anti-Idiotype Vaccine Elicits a Specific Response to N-Glycolyl Sialic Acid Residues of Glycoconjugates in Melanoma Patients, The Journal of Immunology, 2002, vol. 168, No # , pp. 3523-2529.
Alonso, Ruby et al., Towards the Definition of a Chimpanzee and Human Conserved CD6 Domain 1 Epitope Recognized by T1 Monoclonal Antibody, Hybridoma, 2008, vol. 27, No. 4, pp. 291-301.
Alprolix, Highlights of Prescribing Information, Full Prescribing Information, Biogen Idec,2013, No Vol, pp. 1-19.
David McAuley, Pharm.D., Alzheimer's Disease—Therapeutic agents, 2012, No Vol. #, pp. 1-3.
Angevin, Eric et al., A Phase I/II, Multiple-Dose, Dose-Escalation Study of Siltuximab, an Anti-Interleukin-6 Monoclonal Antibody, in Patients with Advanced Solid Tumors, Clinical Cancer Research, 2014, vol. 20, No. 8, pp. 1-14.
Micromedex, Antihemophilic Factor Viii and Von Willebrand Factor Complex (Intravenous Route) , Mayo Clinic, No. Vol #, pp. 1-3.

(56) References Cited

OTHER PUBLICATIONS

Armstrong, Deborah, et al., Farletuzumab (MORAb-003) in platinum-sensitive ovarian cancer patients experiencing a first relapse, Community Oncology, 2010, vol. 7, No. 2, Supp 1., pp. 1-4.
Baeten, Dominique et al., Anti-interleukin-17A monoclonal antibody secukinumab in treatment of ankylosing spondylitis: a randomised, double-blind, placebo-controlled trial, The Lancet, 2013, vol. 382, No #, pp. 1705-1713.
Bai, D.L. et al., Huperzine A, A Potential Therapeutic Agent for Treatment of Alzheimer's Disease, Current Medicinal Chemistry, 2000, vol. 7, No. 3, pp. 355-374.
Ballatore, Carlo et al., Microtubule Stabilizing Agents as Potential Treatment for Alzheimer's Disease and Related Neurodegenerative Tauopathies, J. Med Chem., 2012, vol. 55, No. 21, pp. 8979-8996.
Barker, Edward, et al., Effect of a Chimeric Anti-Ganglioside GD2 Antibody on Cell-mediated Lysis of Human Neuroblastoma Cells, Cancer Researchm, 1991, vol. 51, No. #, pp. 144-149.
Bamias, Giorgos, et al., Leukocyte Traffic Blockage in Inflammatory Bowel Disease, Current Drug Targets, 2013, vol. 14, No. 12, pp. 1490-1500.
Blom, Dirk J. et al., A 52-Week Placebo-Controlled Trial of Evolocumab in Hyperlipidemia, The New England Journal of Medicine, 2014, No. Vol #, pp. 1-11.
Bococizumab, Statement on a Nonproprietary Name Adopted by the USAN Council, 2013, No Vol. pp. 1-2.
Bohrmann, Bernd et al., Gantenerumab: A Novel Human Anti-Aβ Antibody Demonstrates Sustained Cerebral Amyloid-β Binding and Elicits Cell-Mediated Removal of Human Amyloid-β, Journal of Alzheimer's Disease, 2012, vol. 28, No. #, pp. 49-69.
Borghaei, Hossein et al., Phase I Dose Escalation, Pharmacokinetic and Pharmacodynamic Study of Naptumomab Estafenatox Alone in Patients With Advanced Cancer and With Docetaxel in Patients With Advanced Non-Small-Cell Lung Cancer, Journal of Clinical Oncology, 2009, vol. 27, No. 25, pp. 4116-4123.
Bottero, Federica et al., GeneTransfection and Expression of the Ovarian Carcinoma Marker Folate Binding Protein on NIH/3T3 Cells Increases Cell Growth in Vitro and in Vivo, Cancer Research, 1993, vol. 53, No. #, pp. 5791-5796.
Bousquet, Jean MD et al, Eosinophilic Inflammation in Asthma, The New England Journal of Medicine, 1990, vol. 323, No. 15, pp. 1033-1039.
Burgess, Teresa et al., Biochemical Characterization of AMG 102: A Neutralizing, Fully Human Monoclonal Antibody to Human and Nonhuman Primate Hepatocyte Growth Factor, Molecular Cancer Therapeutics, 2010, vol. 9, No. 2, pp. 400-409.
Busse, William W. et al., Safety profile, pharmacokinetics, and biologic activity of MEDI-563, an anti-IL-5 receptor a antibody, in a phase I study of subjects with mild asthma, J Allergy Clin Immunol, 2010, vol. 125, No. 6, pp. 1237-1244.
Carnahan, Josette et al., Epratuzumab, a Humanized Monoclonal Antibody Targeting CD22 Characterization of in Vitro Properties, Clinical Cancer Research, 2009, vol. 9, No. #, pp. 1-8.
Castro, Mario et al., Reslizumab for Poorly Controlled, Eosinophilic Asthma, A Randomized, Placebo-controlled Study, American Journal of Respiratory and Critical Care Medicine, 2011, vol. 184, No#, pp. 1125-1132.
Cavelti-Weder, Claudia et al., Effects of Gevokizumab on Glycemia and Inflammatory Markers in Type 2 Diabetes, Diabetes Care, 2012, vol. 35, No number, pp. 1654-1662.
Chou, Hsun-Hua et al., A mutation in human CMP-sialic acid hydroxylase occurred after the Homo-Pan divergence, Proc. Natl. Acad. Sci. USA,1998, vol. 95, No #, pp. 11751-11756.
Grundy, Scott et al., Promise of Low-Density Lipoprotein-Lowering Therapy for Primary and Secondary Prevention, Circulation Journal of the American Heart Association, 2008, vol. 117, No #, pp. 569-573.
Raal, Frederick et al., Low-Density Lipoprotein Cholesterol-Lowering Effects of AMG 145, a Monoclonal Antibody to Proprotein Convertase Subtilisin/Kexin Type 9 Serine Protease in Patients With Heterozygous Familial Hypercholesterolemia: The Reduction of LDL-C With PCSK9 Inhibition in Heterozygous Familial Hypercholesterolemia Disorder (Rutherford) Randomized Trial, Circulation, 2012, vol. 126, pp. 2408-2417.
Roche Pharma AG, A Study to Evaluate Two Doses of Ocrelizumab in Patients With Active Systemic Lupus Erythematosus (BEGIN), ClinicalTrials.gov, Apr. 1, 2014, No Vol #, http://clinicaltrials.gov/ct2/show/NCT00539838, pp. 1-4.
Genentech, A Study of the Efficacy and Safety of Ocrelizumab in Patients With Relapsing-Remitting Multiple Sclerosis, ClinicalTrials.gov, Apr. 1, 2014, http://clinicaltrials.gov/ct2/show/NCT00676715, pp. 1-3.
Morphotek, Efficacy and Safety of MORAb-003 in Subjects With Platinum-sensitive Ovarian Cancer in First Relapse, ClinicalTrials.gov, Apr. 2, 2014, http://clinicaltrials.gov/ct2/show/NCT00849667?term=Farletuzumab&rank=4&submit_fld_opt, pp. 1-3.
Roche Pharma AG, A Study to Investigate the Efficacy and Safety of Bendamustine Compared With Bendamustine +RO5072759 (GA101) in Patients With Rituximab-Refractory, Indolent Non-Hodgkin's Lymphoma (GADOLIN), ClinicalTrials.gov, Apr. 2, 2014, http://clinicaltrials.gov/ct2/show/NCT01059630?term=Obinutuzumab&rank=20&submit_fld_opt, pp. 1-3.
Eli Lilly and Company, A Study of Ramucirumab (IMC-1121B) Drug Product (DP) and Best Supportive Care (BSC) Versus Placebo and BSC as 2nd-Line Treatment in Patients With Hepatocellular Carcinoma After 1st-Line Therapy With Sorafenib (REACH), ClinicalTrials.gov , Apr. 2, 2014, http://clinicaltrials.gov/ct2/show/NCT01140347?term=ramucirumab&rank=12&submit_fld_opt, pp. 1-4.
Eli Lilly and Company, A Study of Chemotherapy and Ramucirumab vs. Chemotherapy Alone in Second Line Non-small Cell Lung Cancer Participants Who Received Prior First Line Platinum Based Chemotherapy, ClinicalTrials.gov, Apr. 2, 2014, http://clinicaltrials.gov/ct2/show/NCT01168973?term=ramucirumab&rank=2&submit_fld_opt, pp. 1-4.
Eli Lilly and Company, A Study of Paclitaxel With or Without Ramucirumab in Metastatic Gastric Adenocarcinoma, ClinicalTrials.gov, Apr. 2, 2014, http://clinicaltrials.gov/ct2/show/NCT01170663?term=ramucirumab&rank=5&submit_fld_opt, pp. 1-4.
Eli Lilly and Company, A Study in Second Line Metastatic Colorectal Cancer, ClinicalTrials.gov, Apr. 2, 2014, http://clinicaltrials.gov/ct2/show/NCT01183780?term=ramucirumab&rank=20&submit_fld_opt., pp. 1-4.
Hoffmann-La Roche, A Study of Obinutuzumab (RO5072759) in Combination With CHOP Chemotherapy Versus MabThera/Rituxan (Rituximab) With CHOP in Patients With CD20-Positive Diffuse Large B-Cell Lymphoma (GOYA), ClinicalTrials.gov, Apr. 2, 2014, http://clinicaltrials.gov/ct2/show/NCT01287741?term=Obinutuzumab&rank=13&submit_fld_opt, pp. 1-3.
Hoffmann-La Roche, A Study of Obinutuzumab (RO5072759) Plus Chemotherapy in Comparison With MabThera/Rituxan (Rituximab) Plus Chemotherapy Followed by GA101 or MabThera/Rituxan Maintenance in Patients With Untreated Advanced Indolent Non-Hodgkin's Lymphoma (GALLIUM), ClinicalTrials.gov, Apr. 2, 2014, http://clinicaltrials.gov/ct2/show/NCT01332968, pp. 1-3.
Avid Radiopharmaceuticals, Dominantly Inherited Alzheimer Network Trial: An Opportunity to Prevent Dementia. A Study of Potential Disease Modifying Treatments in Individuals at Risk for or With a Type of Early Onset Alzheimer's Disease Caused by a Genetic Mutation. (DIAN-TU), ClinicalTrials.gov, Apr. 2, 2014, http://clinicaltrials.gov/ct2/show/NCT01760005, pp. 1-5.
Eli Lilly and Company, Progress of Mild Alzheimer's Disease in Participants on Solanezumab Versus Placebo (Expedition 3), ClinicalTrials.gov, Apr. 2, 2014, http://clinicaltrials.gov/ct2/show/NCT01900665, pp. 1-3.
Eli Lilly and Company, Clinical Trial of Solanezumab for Older Individuals Who May be at Risk for Memory Loss (A4), ClinicalTrials.gov, Apr. 2, 2014, http://clinicaltrials.gov/ct2/show/NCT02008357, pp. 1-3.

(56) References Cited

OTHER PUBLICATIONS

Cohen, Idan et al., Differential release of chromatin-bound IL-1a Discriminates Between Necrotic and Apoptotic Cell Death by the Ability to Induce Sterile Inflammation, PNAS, 2010, vol. 107, No. 6, pp. 2574-2579.
Conde, Francisco et al. , The Aspergillus toxin restrictocin is a suitable cytotoxic agent for generation of immunoconjugates with monoclonal antibodies directed against human carcinoma cells, Eur. J. Biochem, 1989, vol. 178, No #, pp. 795-802.
Coney, Leslie et al., Cloning of Tumor-associated Antigen: MOv18 and MOv19 Antibodies Recognize a Folate-binding Protein, Cancer Research, 1991, vol. 51, No #, pp. 6125-6132.
Corren, Jonathan et al., Lebrikizumab Treatment in Adults with Asthma, The New England Journal of Medicine, 2011, vol. 365, No. 12, pp. 1088-1098.
Daridon, Capucine et al., Epratuzumab Affects B Cells Trafficking in Systemic Lupus Erythematosus, Ann Rheum Dis, 2011, vol. 70, No #, pp. 1-2.
Devine, Peter L. et al., The Breast Tumor-associated Epitope Defined by Monoclonal Antibody 3E1.2 Is an O-linked Mucin Carbohydrate Containing N-Glycolylneuraminic Acid, Cancer Research, 1991, vol. 51, No #, pp. 5826-5836.
DiJoseph, John F. et al., Antibody-targeted chemotherapy with CMC-544: a CD22-targeted immunoconjugate of calicheamicin for the treatment of B-lymphoid malignancies, Blood, 2004, vol. 103, No #, pp. 1807-1814.
Dodart, Jean-Cosme et al., Immunization reverses memory deficits without reducing brain A burden in Alzheimer's disease model, Nature Neuroscience, 2002, vol. 5, No. 5, pp. 452-457.
Doody, Rachelle S. et al., Phase 3 Trials of Solanezumab for Mild-to-Moderate Alzheimer's Disease, NEJM Journal Watch, Apr. 2, 2014, No vol. No #, http://www.nejm.org/doi/full/10.1056/NEJMoa1312889, pp. 1-2.
National Cancer Institute, Drugs Approved for Ovarian Cancer, Aug. 16, 2013, No Vol.,pp. 1-2.
Dumont, Jennifer A. et al., Prolonged activity of a recombinant factor VIII-Fc fusion protein in hemophilia A mice and dogs, Blood, 2012, vol. 119, No. #, pp. 3024-3030.
Ebel, Wolfgang et al, Preclinical Evaluation of MORAb-003, a Humanized Monoclonal Antibody Antagonizing Folate Receptor-alpha, Cancer Immunity, 2007, vol. 7 No #, pp. 1-8.
Eisen, Tim et al., Naptumomab Estafenatox: Targeted Immunotherapy with a Novel Immunotoxin, Curr Oncol Rep, 2014, vol. 16, N. 370 pp. 2-6.
Erlandsson, Eva et al., Identification of the Antigenic Epitopes in Staphylococcal Enterotoxins A and E and Design of A Superantigen for Human Cancer Therapy, J. Mol. Biol., 2003, vol. 333, No #, pp. 893-905.
Mayo Clinic, Factor Ix Complex (Intravenous Route, Injection Route) Description and Brand Names—Drugs and Supplements, http://www.mayoclinic.org/drugs-supplements/factor-ix-complex-intravenous-route-injection-route/description/drg-20063804, Apr. 1, 2014, No Vol., pp. 1-3.
Ferrara, Claudia et al., Unique carbohydrate-carbohydrate interactions are required for high affinity binding between FcγRIII and antibodies lacking core fucose, PNAS, 2011, No Vo. #, pp. 1-6.
Figini, M. et al., Reversion of transformed phenotype in ovarian cancer cells by intracellular expression of anti folate receptor antibodies, Gene Therapy, 2003 vol. 10, No #, pp. 1018-1025.
Vasquez, Ana et al., Racotumomab: an anti-idiotype vaccine related to N-Glycolyl-containing gangliosides-preclinical and clinical date, Frontiers in Oncology, 2012, vol. 2, Article 150, pp. 1-6.
Forsberg, G. et al., Therapy of Human Non-Small-Cell Lung Carcinoma Using Antibody Targeting of a Modified Superantigen, British Journal of Cancer, 2001, vol. 85, No. 1, pp. 129-136.
Forsberg, G et al., Naptumomab Estafentoz, an Engineered Antibody-superantigen Fusion Protien with Low Toxicity and Reduced Antigenicity, J Immunother, 2010, vol. 33, No. 5, pp. 492-499.

Feagan, Brian et al., Vedolizumab as Induction and Maintenance Therapy for Ulcerative Colitis, The New England Journal of Medicine, 2013, vol. 369, No. 8, pp. 699-710.
Furie, Richard et al., A Phase III, Randomized, Placebo-Controlled Study of Belimumab, a Monoclonal Antibody That Inhibits B Lymphocyte Stimulator, in Patients With Systemic Lupus Erythematosus, Arthritis & Rheumatism, 2011, vol. 63, No. 12, pp. 3918.3930.
Garcia, Gilles et al., Anti-interleukin-5 Therapy in Serve Asthma, Rare Diseases and Orphan Drugs, 2013, vol. 22, No. #, pp. 251-257.
Garin-Chesa, Pilar et al., Trophoblast and Ovarian Cancer Antigen LK26, American Journal of Pathology, 1993, vol. 142, No. 2, pp. 557-567.
Genovese, Mark C et al., Efficacy and safety of secukinumab in patients with rheumatoid arthritis: a phase II, dose-finding, double-blind, randomised, placebo controlled study, Ann Rheum Dis, 2013; vol. 72, No #, pp. 863-869.
Genovese, Mark C et al., A phase 2 dose-ranging study of subcutaneous tabalumab for the treatment of patients with active rheumatoid arthritis and an inadequate response to methotrexate, Ann Rheum Dis 2013; vol. 72, No#, pp. 1453-1460.
Genovese, Mark C et al., Ocrelizumab, a Humanized Anti-CD20 Monoclonal Antibody, in the Treatment of Patients With Rheumatoid Arthritis, Arthritis & Rheumatism, 2008, vol. 58, No. 9, pp. 2652-2661.
Gevaert, Philippe, et al., Mepolizumab, a humanized anti-IL-5 mAb, as a treatment option for severe nasal polyposis, Rhinitis, sinusitis, and upper airway disease, J Allergy Clin Immunol, 2011, vol. 128, No. 5, pp. 989-995.
Ghazi, Aasia et al., Benralizumab—a humanized mAb to IL-5Rα with enhanced antibody-dependent cell-mediated cytotoxicity—a novel approach for the treatment of asthma, Expert Opin Biol Ther. 2012, vol. 12, No. 1, pp. 113-118.
Gillies, Stephen et al., Antibody-targeted interleukin 2 stimulates T-cell killing of Autologous Tumor Cells, Proc. Natl. Acad. Sci., 1992, vol. 89, No #, pp. 1428-1432.
Grant, Ryan W. et al., Mechanisms of disease: inflammasome activation and the development of type 2 diabetes, Frontiers in Immunology, 2013, vol. 4, Article 50, pp. 1-10.
Greenfeder, Scott et al., Th2 cytokines and asthma the role of interleukin-5 in allergic eosinophilic disease, Respiratory Research, 2001, vol. 2, No. 2, pp. 71-79.
Grünig, Gabriele et al., Interleukin 13 and the evolution of asthma therapy, Am J Clin Exp Immunol, 2012;vol. 1, No. 1, pp. 20-27.
Hamid, Omid et al., Safety and Tumor Responses with Lambrolizumab (Anti-PD-1) in Melanoma, The New England Journal of Medicine, 2013, vol. 369, No. 2, pp. 134-144.
Hank, Jacquelyn, et al., Immunogenicity of the Hu14.18-IL2 Immunocytokine Molecule in Adults With Melanoma and Children With Neuroblastoma, Clinical Cancer Research, 2009, vol. 15, No. 18, pp. 5923-5930.
Hart, Timothy K. et al., Preclinical efficacy and safety of mepolizumab (SB-240563), a humanized monoclonal antibody to IL-5, in cynomolgus monkeys, J Allergy Clin Immunol, 2001, vol. 108, No. 2, pp. 250-257.
Hedlund, Gunnar et al., The Tumor Targeted Superantigen ABR-217620 Selectively Engages TRBV7-9 and Exploits TCR-pMHC Affinity Mimicry in Mediating T Cell Cytotoxicity, PLOS One, 2013, vol. 8, Issue 10, pp. 1-17.
Hernández, Ana María et al., Anti-NeuGcGM3 Antibodies, Actively Elicited by Idiotypic Vaccination in Nonsmall Cell Lung Cancer Patients, Induce Tumor Cell Death by an Oncosis-Like Mechanism, The Journal of Immunology, 2011, vol. 186, No #, pp. 3735-3744.
Humbert, Marc et al., Relationship between IL-4 and IL-5 mRNA Expression and Disease Severity in Atopic Asthma, Am J Respir Crit Care Med, 1997, vol. 156, No #, pp. 704-708.
Hole, N. et al., A 72 kD trophoblast glycoprotein defined by a monoclonal antibody, Br. J. Cancer 1988,vol. 57, No. #, pp. 239-246.
Huizinga, Tom W J et al., Sarilumab, a fully human monoclonal antibody against IL-6Rα in patients with rheumatoid arthritis and an inadequate response to methotrexate: efficacy and safety results

(56) References Cited

OTHER PUBLICATIONS from the randomized SARIL-RA-MOBILITY Part A trial, Ann Rheum Dis, 2013; No Vol. pp. 1-9.
Imbimbo, Bruno P et al., Solanezumab for the treatment of mild-to-moderate Alzheimer's disease, Expert Rev. Clin. Immunol., 2012, vol. 8, No. 2, pp. 135-149.
Ito, Asahi et al., Defucosylated anti-CCR4 monoclonal antibody exercises potent ADCC-mediated antitumor eVect in the novel tumor-bearing humanized NOD/Shi-scid, IL-2R_null mouse model, Cancer Immunol Immunother, 2009, vol. 58, No #, pp. 1195-1206.
Winkler, David G. et al., Noggin and Sclerostin Bone Morphogenetic Protein Antagonists Form a Mutually Inhibitory Complex, J. Biol. Chem., 2004, vol. 279, pp. 36293-36298.
Janssens, Ann et al., Rixuximab for Chronic Lymphocytic Leukemia in Treatment-Naive and Treatment-Experienced, OneLive, Bringing Oncology Together, Apr. 2, 2014, No Vol. , pp. 1-7.
Jia, Guiquan et al., Periostin is a systemic biomarker of eosinophilic airway inflammation in asthmatic patients, J Allergy Clin Immunol, 2012, vol. 130, No. 3, pp. 647-654.
Jin, Wei et al., IL-17 cytokines in immunity and inflammation, Emerging Microbes and Infections, 2013, vol. 2, No. #, pp. 1-5.
Kappos, Ludwig, et al., Ocrelizumab in relapsing-remitting multiple sclerosis: a phase 2, randomised, placebo-controlled, multicentre trial, The Lancet, 2011, vol. 378, Issue 9805, pp. 1779-1787.
Kaur, Sukhwinder et al., Mucins in pancreatic cancer and its microenvironment, Nature Reviews, 2013, No Vol., pp. 1-14.
Kausar, Fariha et al., Ocrelizumab: A Step Forward in the Evolution of B-Cell Therapy, Expert Opinion Biol. Ther., 2009, vol. 9, No. 7, pp. 889-895.
Kim, Busun et al., The Interleukin-1a precursor is Biologically Active and Is Likely a Key Alarmin in the IL-1 Family of Cytokines, Frontiers in Immunology, 2013, vol. 4, Article 391, pp. 1-9.
Kips, Johan et al., Effect of SCH55700, a Humanized Anti-Human Interleukin-5 Antibody, in Severe Persistent Asthma, American Journal of Respiratory and Critical Care Medicine, Safety of Anti-IL-5 in Asthma, vol. 167, pp. 1655-1659, 2003.
Koenigsknecht-Talboo, Jessica et al., Rapid Microglial Response Around Amyloid Pathology after Systemic Anti-A_Antibody Administration in PDAPP Mice, The Journal of Neuroscience, 2008, vol. 28, No. 52, pp. 14156-14164.
Kolbeck, Roland et al., MEDI-563, a humanized anti-IL-5 receptor a mAb with enhanced antibody-dependent cell-mediated cytotoxicity function, J Allergy Clin Immunol, vol. 125, No. 6, pp. 1344-1353.
Koren, Michel J. et al., Efficacy and Safety of Longer-Term Administration of Evolocumab (AMG 145) in Patients With Hypercholesterolemia: 52-Week Results From the Open-Label Study of Long-Term Evaluation Against LDL-C (OSLER) Randomized Trial, Circulation, 2013, No Vol., pp. 1-20.
Kreitman, Robert J. et al., Antibody Fusion Proteins: Anti-CD22 Recombinant Immunotoxin Moxetumomab Pasudotox, Clinical Cancer Research, 2011, vol. 17, No #, pp. 6398-6405.
Kreitman, Robert J. et al., Phase I Trial of Anti-CD22 Recombinant Immunotoxin Moxetumomab Pasudotox (CAT-8015 or HA22) in Patients With Hairy Cell Leukemia, Journal of Clinical Oncology, 2012, vol. 30, No. 15, pp. 1822-1826.
Krueger, Gerald G. et al., A Human Interleukin-12/23 Monoclonal Antibody for the Treatment of Psoriasis, The New England Journal of Medicine, 2007,vol. 356, No. 6, pp. 580-592.
Kuenen, Bart et al., A Phase I Pharmacologic Study of Necitumumab (IMC-11F8), a Fully Human IgG 1 Monoclonal Antibody Directed Against EGFR in Patients with Advanced Solid Malignancies, Clinical Cancer Research, 2010, vol. 16, No #, pp. 1915-1923.
Kuijpers, Taco W. et al., CD20 deficiency in humans results in impaired T cell—independent antibody responses, The Journal of Clinical Investigation, 2010, vol. 120, No. 1, pp. 214-222.
Kurzrock, Razelle et al., A Phase I, Open-Label Study of Siltuximab, an Anti-IL-6 Monoclonal Antibody, in Patients with B-cell Non-Hodgkin Lymphoma, Multiple Myeloma, or Castleman Disease,Clinical Cancer Research, 2013, vol. 19, No #, pp. 3659-3670.
Lach-Trifilieff, Estelle et al., An Antibody Blocking Activin Type II Hypertrophy and Protects from Atrophy Receptors Induces Strong Skeletal Muscle, Molecular and Cellular Biology, 2004, vol. 34, No. 4, pp. 606-618.
Legleiter, Justin et al., Effect of Different Anti-Aβ Antibodies on Aβ Fibrillogenesis as AAssessed by Atomic Force Microscopy, J. Mol. Biol, 2004, vol. 335, No #, pp. 997-1006.
Leonard, JP et al., Preclinical and clinical evaluation of epratuzumab (anti-CD22 IgG) in B-cell malignancies, Oncogene, 2007, vol. 26 No #, pp. 3704-3713.
Leonardi, Craig et al., Anti-Interleukin-17 Monoclonal Antibody Ixekizumab in Chronic Plaque Psoriasis, The New England Journal of Medicine, 2012, vol. 366, No. 13, pp. 1190-1199.
Lindén, Ola, et al., Dose-Fractionated Radioimmunotherapy in Non-Hodgkin's Lymphoma Using DOTA-Conjugated, 90Y-Radiolabeled, Humanized Anti-CD22 Monoclonal Antibody, Epratuzumab, Clinical Cancer Research, 2005, vol. 11, No #, pp. 5215-5222.
Braun, Stephen et al., Preclinical Studies of Lymphocyte Gene Therapy for Mild Hunter Syndrome (Mucopolysaccharidosis Type II), Human Gene Therapy, 1996, vol. 7, pp. 283-290.
Liu, Alvin et al, Production of a Mouse-Human Chimeric Monoclonal Antibody to CD20 With Potent Fc-Dependent Biological Activity, The Journal of Immunology, 1987,vol. 139, No. 10, pp. 3521-3526.
Lonial, Sagar, et al., Elotuzumab in Combination With Lenalidomide and Low-Dose Dexamethasone in Relapsed or Refractory Multiple Myeloma, Journal of Clinical Oncology, 2012, vol. 30, No. 16, pp. 1953-1959.
Lu, Dan et al., Tailoring in Vitro Selection for a Picomolar Affinity Human Antibody Directed against Vascular Endothelial Growth Factor Receptor 2 for Enhanced Neutralizing Activity, The Journal of Biological Chemistry, 2003, vol. 278, No. 44, pp. 43496-43507.
Lubberts, Erik et al., Treatment With a Neutralizing Anti-Murine Interleukin-17 Antibody After the Onset of Collagen-Induced Arthritis Reduces Joint Inflammation, Cartilage Destruction, and Cone Erosion, Arthritis & Rheumatism, 2004, vol. 50, No. 2, pp. 650-659.
MacLean, Catherine et al., Ststematic Review: Comparative Effectiveness of Treatments to Prevent Fractures in Men and Women with Low Bone Density or Osteoporosis, Annals of Internal Medicine, 2008, vol. 148, No. 3, pp. 197-217.
Marquina, Gilda et al., Gangliosides Expressed in Human Breast Cancer, Cancer Res, 1996; vol. 56, No #, pp. 5165-5171.
Matsue, Hiroyuki et al., Folate receptor allows cells to grow in low concentrations of 5-methyltetrahydrofolate, Proc. Natl. Acad. Sci. USA, Cell Biology, 1992, vol. 89, No #, pp. 6006-6009.
McInnes, Iain B et al., Efficacy and safety of secukinumab, a fully human anti-interleukin-17A monoclonal antibody, in patients with moderate-to-severe psoriatic arthritis: a 24-week, randomised, double-blind, placebo-controlled, phase II proof-of-concept trial, Ann Rheum Dis, 2014; vol. 73, No. #, pp. 349-356.
McKenney, James M. et al., Safety and Efficacy of a Monoclonal Antibody to Proprotein Convertase Subtilisin/GKexin Type 9 Serine Protease, SAR236553/REGN727, in Patients With Primary Hypercholesterolemia Receiving Ongoing Stable Atorvastatin Therapy, Journal of the American College of Cardiology, 2012, vol. 59, No. 25, pp. 2344-2353.
Di Meglio, Paola et al., The role of IL-23 in the immunopathogenesis of psoriasis, Biology Reports, 2010, vol. 2, No. 40, pp. 1-5.
Merelli, Barbara et al., Targeting the PD1/PD-L1 axis in melanoma: Biological rationale, clinical challenges and opportunities, Critical Reviews in Oncology/Hematology, 2014, vol. 89, No #, pp. 140-165.
Moreaux, Jérôme et al., BAFF and APRIL protect myeloma cells from apoptosis induced by interleukin 6 deprivation and dexamethasone, Blood, 2004, vol. 103, No #, pp. 3148-3157.
Morgan, D., Immunotherapy for Alzheimer's disease, Journal of Internal Medicine, 2011, vol. 269, No #, pp. 54-63.

(56) References Cited

OTHER PUBLICATIONS

Mujoo, Kalpana et al., Disialoganglioside GD2 on Human Neuroblastoma Cells: Target Antigen for Monoclonal Antibody-mediated Cytolysis and Suppression of Tumor Growth, Cancer Research, 1987, vol. 47, No #, 1098-1104.

Mujoo, Kalpana et al., Functional Properties and Effect on Growth Suppression of Human Neuroblastoma Tumors by Isotype Switch Variants of Monoclonal Antiganglioside GD2 Antibody 14.18, Cancer Research, 1989, vol. 49, No #, pp. 2857-2861.

Mössner, Ekkehard, Increasing the efficacy of CD20 antibody therapy through the and immune effector cell-mediated B-cell cytotoxicity engineering of a new type II anti-CD20 antibody with enhanced direct, Blood, 2010, vol. 115, No #, pp. 4393-4402.

Nair, P. et al., CD6 synergistic co-stimulation promoting proinflammatory response is modulated without interfering with the activated leucocyte cell adhesion molecule interaction, Clinical& Experimental Immunology, 2010, vol. 162, No #, pp. 116.130. Experimental Immunology, i_4235.

Neal, Zane C. et al., Enhanced Activity of Hu14.18-IL2 Immunocytokine against Murine NXS2 Neuroblastoma when Combined with Interleukin 2 Therapy, Clinical Cancer Research, 2004, vol. 10, pp. 4839-4847.

Neer, Robert M. et al., Effect of Parathyroid Hormone (1-34) on Fractures and Bone Mineral Density in Postmenopausal Women With Osteoporosis, The New England Journal of Medicine, 2001, vol. 344, No. 19, pp. 1434-1441.

Negrier, Claude et al., Enhanced pharmacokinetic properties of a glycoPEGylated recombinant factor IX: a first human dose trial in patients with hemophilia B, Blood, 2011, vol. 118, No #, pp. 2695-2701.

Neninger, Elia et al., Active Immunotherapy with 1E10 Anti-Idiotype Vaccine in Patients with Small Cell Lung Cancer, Cancer Biology & Therapy, 2007, vol. 6, No. 2, pp. 1-6.

Novakovic, Dijana et al., Profile of Gantenerumab and Its Potential in the Treatment of Alzheimer's Disease, Drug Design, Development and Therapy, 2013, vol. 7, No #, pp. 1359-1364.

Wright, Timothy M.D., Transforming Molecules into Breakthrough Therapies, Novartis, Investor Day, London,2013, No Vol. pp. 1-16.

Oldhoff et al., Anti-IL-5 recombinant Humanized Monoclonal Antibody (Mepolizumab) for the treatment of atopic dermatitis, Allergy, 2005, vol. 60, No # pp. 693-696.

Ostrowitzki, Susanne et al., Mechanism of Amyloid Removal in Patients with Alzheimer Disease Treated with Gantenerumab, Arch Neurol., 2012, vol. 69, No. 2, pp. 1-10.

Ottone, F. et al., Relationship Between folate-binding Protein Expression and Cisplatin Sensitivity in Ovarian Carcinoma Cell Lines, British Journal of Cancer, 1997, vol. 76, No. 1, pp. 77-82.

Papp, KA et al., Anti-IL-17 Receptor Antibody AMG 827 Leads to Rapid Clinical Response in Subjects with Moderate to Severe Psoriasis: Results from a Phase I, Randomized, Placebo-Controlled Trial, Journal of Investigative Dermatology, 2012, vol. 132, No #, pp. 2466-2469.

Papp, Kim, et al., Brodalumab, an Anti-Interleukin-17-Receptor Antibody for Psoriasis, The New England Journal of Medicine, 2012, vol. 366, No. 13, pp. 1181-1189.

Papp, KA et al, Efficacy and safety of secukinumab in the treatment of moderate-to-severe plaque psoriasis: a randomized, double-blind, placebo-controlled phase II dose-ranging study, 2013,British Journal of Dermatology, vol. 168, No #, pp. 412-421.

Pasadhika, Sirichai et al., Update on the use of systemic biologic agents in the treatment of oninfectious uveitis, Biologics: Targets and Therapy, 2014, vol. 8 No #, pp. 67-81.

Pavord, Ian D et al., Mepolizumab for severe eosinophilic asthma (DREAM): a multicentre, double-blind, placebo-controlled trial, The Lancet, 2012, vol. 380, No Vol #, 2012, pp. 651-659.

Sanofi, Fact Sheet, PCSK9 and Alirocumab Backgrounder, Regeneron, 2013, No Vol. pp. 1-3.

Peters, R.T. et al., Biochemical and functional characterization of a recombinant monomeric factor VIII-Fc fusion protein, Journal of Thrombosis and Haemostasis, 2012, vol. 11, pp. 132-141.

Powell, Jerry S. et al., Safety and prolonged activity of recombinant factor VIII Fc fusion protein in hemophilia A patients, Blood, 2012, vol. 119, No #, pp. 3031-3037.

Prewett, Marie et al., Kinase 1) Monoclonal Antibody Inhibits Tumor Angiogenesis Antivascular Endothelial Growth Factor Receptor (Fetal Liver Kinase 1) Monoclonal Antibody Inhibits Tumor Angiogenesis and Growth of Several Mouse and Human Tumors, Cancer Res, 1999; vol. 59, No #, pp. 5209-5218.

Raal, Frederick et al., Elevated PCSK9 Levels in Untreated Patients With Heterozygous or Homozygous Familial Hypercholesterolemia and the Response to High-Dose Statin Therapy, Journal of the American Heart Association, 2013, No Vol., pp. 1-8.

Rich, PP. et al., Secukinumab induction and maintenance therapy in moderate-to-severe plaque psoriasis: a randomized, double-blind, placebo-controlled, phase II regimen-finding study, British Journal of Dermatology, Therapeutics, 2013, vol. 168, No #, pp. 402-411.

Rossi, Edmund et al., Trogocytosis of Multiple B-cell Surface Markers by CD22 Targeting With Epratuzumab, Blood, 2013, vol. 122, No #, pp. 3020-3029.

Rossjohn, Jamie et al., Structure of the activation domain of the GM-CSF/IL-3/IL-5 receptor common β-chain bound to an antagonist, Blood, 2000, vol. 95, No #, pp. 2491-2498.

Roth, Eli M. et al., Atorvastatin with or without an Antibody to PCSK9 in Primary Hypercholesterolemia, The New England Journal of Medicine, 2012, vol. 367, vol. 20, pp. 1891-1900.

Roufosse, Florence E., et al., Long-term safety of mepolizumab for the treatment of hypereosinophilic syndromes, J Allergy Clin Immunol. 2013; vol. 131, No. 2, pp. 461-467.

Salles, Gilles et al., Phase 1 study results of the type II glycoengineered humanized lymphoma patients anti-CD20 monoclonal antibody obinutuzumab (GA101) in B-cell, Blood, 2012, vol. 119, No #., pp. 5126-5132.

Sandborn, William J. et al., Vedolizumab as Induction and Maintenance Therapy for Crohn's Disease, The New England Journal of Medicine, 2013, vol. 369, No. 8, pp. 711-721.

Schuelke, Markus M.D. et al., Myostatin Mutation Associated With Gross Muscle Hypertrophy in a Child, The New England Journal of Medicine, 2004, vol. 350, No. 26, pp. 2862-2688.

Shusterman, Suzanne et al., Antitumor Activity of Hu14.18-IL2 in Patients With Relapsed/Refractory Neuroblastoma: A Children's Oncology Group (COG) Phase II Study, Journal of Clinical Oncology, 2010, vol. 28, No. 33, pp. 4969-4975.

Hueber, Wolfgang et al., Effects of AIN457, a Fully Human Antibody to Interleukin-17A, on Psoriasis, Rheumatoid Arthritis, and Uveitis, Science Translational Medicine, 2010, vol. 2, Issue 52, pp. 1-9.

Scursoni, Alejandra M. Et al., Detection of N-Glycolyl GM3 Ganglioside in Neuroectodermal Tumors by Immunohistochemistry: An Attractive Vaccine Target for Aggressive Pediatric Cancer, Clinical and Developmental Immunology, 2011, vol. 2011, Article ID., 245181, pp. 1-6.

Semënov, Mikhail et al., SOST Is a Ligand for LRP5/LRP6 and a Wnt Signaling Inhibitor, The Journal of Biological Chemistry, 2005, vol. 280, No. 29., pp. 26770-26775.

Shapiro, Amy D. et al., Recombinant factor IX-Fc fusion protein (rFIXFc) demonstrates safety and prolonged activity in a phase 1/2a study in hemophilia B patients, Blood, 2012, vol. 119, No #, pp. 666-672.

Sieger, N. et al., CD22 Ligation Inhibits Downstream B Cell Receptor Signaling and Ca2_Flux Upon Activation, Arthritis & Rheumatism, 2013, vol. 65, No. 3, pp. 770-779.

Simon, Thorsten et al., Consolidation Treatment With Chimeric Anti-GD2-Antibody ch14.18 in Children Older Than 1 Year With Metastatic Neuroblastoma, Journal of Clinical Oncology, 2004, vol. 22, No. 17, pp. 3549-3557.

Spratlin, Jennifer L. et al., Phase I Pharmacologic and Biologic Study of Ramucirumab (IMC-1121B), a Fully Human Immunoglobulin G1 Monoclonal Antibody Targeting the Vascular Endothelial Growth Factor Receptor-2, Journal of Clinical Oncology, 2010, vol. 28, No. 5, pp. 780-787.

Steinfield, Serge et al., Epratuzumab (humanized anti-CD22 antibody) in autoimmune diseases, Expert Opinion, 2006, vol. 6, No. 9, pp. 943-949.

(56) References Cited

OTHER PUBLICATIONS

Stevenson, Frazier et al., The N-terminal propiece of interleukin Ia is a transforming nuclear oncoprotein, Proc. Natl. Acad. Sci. USA, 1997, vol. 94, No #, pp. 508-513.
William Stohl et al., Future prospects in biologic therapy for systemic lupus erythematosus, Nature Reviews, Rheumatology, No Vol., pp. 1-16.
Sullivan, David et al., Effect of a Monoclonal Antibody to PCSK9 on Low-Density Lipoprotein Cholesterol Levels in Statin-Intolerant Patients the GAUSS Randomized Trial, JAMA, 2012, vol. 308, No. 23, pp. 1-10.0.
Sun, Jian, et al., B lymphocyte stimulator: a new target for treating B cell malignancies, Chinese Medical Journal, 2008; vol. 12, No. 14, pp. 1319-1323.
Tanaka, Toshio et al., Targeting Interleukin-6: All the Way to Treat Autoimmune and Inflammatory Diseases, International Journal of Biological Sciences, 2012, vol. 8 No. 9, pp. 1227-1236.
Toffoli1, Giuseppe et al., Overexpression of Folate Binding Protein in Ovarian Cancers, 1997, Int. J. Cancer (Pred. Oncol.):vol. 74, No #, pp. 193-198.
Gevokizumab, Statement on a Nonproprietary Name Adopted by the USAN Council, No year no Volume p. 1.
Romosozumab, Statement on a Nonproprietary Name Adopted by the USAN Council, No Year, No Volume, p. 1.
van Bezooijen, Rutger L. et al., Sclerostin Is an Osteocyte-expressed Negative Regulator of Bone Formation, But Not a Classical BMP Antagonist, The Journal of Experimental Medicine, 2004, vol. 199, No. 6, pp. 805-814.
van Bezooijen, Rutger L et al., Wnt but Not BMP Signaling Is Involved in the Inhibitory Action of Sclerostin on BMP-Stimulated Bone Formation, Journal of Bone and Mineral Research, 2007, vol. 22, No. 1, pp. 1-10.
van Cruijsen, Hester et al., Tissue micro array analysis of ganglioside N-glycolyl GM3 expression and signal transducer and activator of transcription (STAT)-3 activation in relation to dendritic cell infiltration and microvessel density in non-small cell lung cancer, BMC Cancer, 2009, vol. 9, No. 180, pp. 1-9.
Wallace, Daniel J. et al., Epratuzumab Demonstrates Clinically Meaningful Improvements in Patients with Moderate to Severe Systemic Lupus Erythematosus (SLE) Results from EMBLEM, a Phase IIB Study, ACR Concurrent Abstract Sessions, Systemic Lupus Enrthematosus—Clinical Aspects and Treatment: New Therapies, 2010, No Vol., pp. 1452.
Wallace, Daniel J et al., Efficacy and safety of epratuzumab in patients with moderate/severe active systemic lupus erythematosus: results from EMBLEM, a phase IIb, randomised, double-blind, placebo-controlled, multicentre study, Ann Rheum Dis, 2014;vol. 73, No #, pp. 183-190.
Wechsler, Michael E. et al., Novel targeted therapies for eosinophilic disorders, J Allergy Clin Immunol., 2012; vol. 130, No. 3, pp. 563-571.
Werman, Ariel et al., The precursor form of IL-1_is an intracrine proinflammatory activator of transcription, PNAS, 2004, vol. 101, No. 8, pp. 2434-2439.
WHO Drug Information, International Nonproprietary Names for Pharmaceutical Substances (INN),2013, vol. 27, No. 4, pp. 1-60.
WHO Drug Information, International Nonproprietary Names for Pharmaceutical Substances (INN), 2012, vol. 26, No. 4, pp. 1-71.
WHO Drug Information, International Nonproprietary Names for Pharmaceutical Substances (INN), 2011, vol. 25, No. 3, pp. 1-46.
WHO Drug Information, International Nonproprietary Names for Pharmaceutical Substances (INN), 2012, vol. 26, No. 2, pp. 1-79.
WHO Drug Information, International Nonproprietary Names for Pharmaceutical Substances (INN), 2012, vol. 26, No. 3, pp. 1-36.
Winkler, David G. et al. Osteocyte control of bone formation via sclerostin, a novel BMP antagonist, The EMBO Journal, 2003, vol. 22 No. 23 pp. 6267-6276.
Yang, Richard K. et al., Anti-GD2 Strategy in the Treatment of Neuroblastoma, Drugs Future, 2010 ; vol. 35, No. 8, pp. 1-15.
Yu, Alice et al., Phase I Truak of a Human-Mouse Chimeric Ant-Disialoganglioside Monoclonal Antibody ch14.18 in Patients with Refractory Neuroblastoma, and Osteosarcoma, Journal of Clinical Oncology1998, , vol. 16, No. 6, pp. 2169-2180.
Zheng, Yue et al. Intracellular Interleukin-1 Receptor 2 Binding Prevents Cleavage and Activity of Interleukin-1a, Controlling Necrosis-Induced Sterile Inflammation, Immunity,2013, vol. 38, No #, pp. 285-295.
Zhu, Min et al., Population Pharmacokinetics of Rilotumumab, a Fully Human Monoclonal Antibody Against Hepatocyte Growth Factor, in Cancer Patients, Journal of Pharmaceutical Sciences, 2014, vol. 328 No #, pp. 328-336.
Zhu, Zhenping et al., Inhibition of Vascular Endothelial Growth Factor-induced Receptor Activation with Anti-Kinase Insert Domain-containing Receptor Single-Chain Antibodies from a Phage Display Library, Cancer Research, 1998, vol. 58, No # pp. 3209-3214.
Zhu, Z et al, Inhibition of human leukemia in an animal model with human antibodies directed against vascular endothelial growth factor receptor 2. Correlation between antibody affinity and biological activity, Leukemia , 2003), vol. 17, pp. 604-611.
Zia-Amirhosseini, P. et al., Pharmacokinetics and Pharmacodynamics of SB-240563, a Humanized Monoclonal Antibody Directed to Human Interleukin-5, in Monkeys, The Journal of Pharmacology and Experimental Therapeutics, 1999, vol. 291, No. 3, pp. 1060-1067.
Stockinger, Walter et al., The PX-domain Protein SNX17 Interacts With Members of the LDL Receptor Family and Modulates Endocytosis, The EMBO Journal, 2002, vol. 21, No. 16 pp. 4259-4267.
Sorrentino, Vincenzo et al., Post-transcriptional regulation of lipoprotein receptors by the E3-ubiquitin ligase inducible degrader of the low-density lipoprotein receptor, Current Opinion, 2012, vol. 23, No. 3, pp. 213-219.
Zelcer, Noam et al., LXR Regulates Cholesterol Uptake through Idol-dependent Ubiquitination of the LDL Receptor, Science, 2009; vol. 325, No. 5936, pp. 100-104.
Zhang , Li et al, Both K63 and K48 ubiquitin linkages signal lysosomal degradation of the LDL receptor, Journal of Lipid Research, 2013, vol. 54, No #, pp. 1410-1420.
Lozier, Jay N , Factor IX Padua: them that have, give , Blood, 2012, vol. 120, No #, pp. 4452-4453.
Simioni, Paolo et al., X-Linked Thrombophilia with a Mutant Factor IX (Factor IX Padua), The New England Journal of Medicine, 2009, vol. 361, No. 17, pp. 1671-1675.
Cornett, Jeff et al. Update of Clinicla Trials to Cure Hemophilia, Hemophilia of Georgia, Dec. 12, 2013, No Vol. pp. 1-2.
Raschke, Silja et al., Adipo-Myokines: Two Sides of the Same Coin—Mediators of Inflammation and Mediators of Exercise, Mediators of Inflammation, 2013, vol. 2013, Article ID 320724, pp. 1-16.
Podbregar, Matej et al., Cytokine Response of Cultured Skeletal Muscle Cells Stimulated with Proinflammatory Factors Depends on Differentiation Stage, The Scientific World Journal, 2013, vol. 2013, Article ID 617170, pp. 1-8.
Guerrero-Ca' zares, Hugo et al. Biodegradable Polymeric Nanoparticles Show High Efficacy and Specificity at DNA Delivery to Human Glioblastoma in Vitro and in Vivo, ACS Nano, 2014, No Vol., No #, pp. 1-14.
Dahlman, James E. et al., In vivo endothelial siRNA delivery using polymeric nanoparticles with low molecular weight, Nature Nanotechnology, 2014, No Vol. #, pp. 1-8.
Kozielski, Kristen L. et al., Bioreducible Cationic Polymer-Based Nanoparticles for Efficient and Environmentally Triggered Cytoplasmic siRNA Delivery to Primary Human Brain Cancer Cells, ACS Nano, 2014, vol. 8, 'No. 4', pp. 3232-3241.
M. Kanapathipillai, et al., Nanoparticle targeting of anti-cancer drugs that alter intracellular signaling or influence the tumor microenvironment, Adv. Drug Deliv. Rev. (2014), , pp. 1-12.
Seldin, Marcus M. et al., Regulation of tissue crosstalk by skeletal muscle-derived myonectin and other myokines, Adipocyte, 2012, vol. 1, No. 4, pp. 200-202.

(56) References Cited

OTHER PUBLICATIONS

Hamrick, Mark W. et al., The skeletal muscle secretome: an emerging player in muscle—bone crosstalk, BoneKEy Reports, 2012, vol. 1, Article No. 60, pp. 1-5.

Compton, J., Nucleic Acid Sequence-Based Amplification, Nature, 1991, vol. 350, No#, pp. 91-92. (Abstract Only).

International Search Report, PCT/US2014/020206, dated May 23, 2014, pp. 1-9.

Kariko, Katalin, et al., Impacts of Nucleoside Modification on RNA-mediated activation of toll-like receptors, 2008, Nucleic Acides in Innate Immunity, No Vol., pp. 171-188.

Cystic Fibrosis Transmembrane Conductance Regulator; cystic fibrosis transmembrane conductance regulator [Homo sapiens]; NCBI, 2010, No Vol., pp. 1-5.

Miotti, S. et al., Characterization of Human Ovarian Carcinoma-Associated Antigens Defined by Novel Monoclonal Antibodies with Tumor-Restricted Specificity, Intl. J. Cancer, 1987, vol. 39, No #, pp. 297-303.

Robak, Tadeusz et al., Current and Emerging Treatments for Chrinic Lymphocytic Leukaemia, Drugs, 2009, vol. 69, No. 17, pp. 2415-2449.

Hutas, Ocrelizumab, a humanized monoclonal antibody against CD20 for inflammatory disorders and B-cell malignancies, Curr Opin Investig Drugs, 2008, vol. 11, No #, pp. 1206-1216. (Abstract Only).

Verma, Sandeep, et.al. , Functional Tuning of Nucleic Acids by Chemical Modifications: Tailored Oligonucleotides as Drugs, Devices, and Diagnodtics, The Japan Chemical Journal Forum and Wiley Periodicals, Inc., 2003, Chem Rec 3, pp. 51-60.

Argininosuccinate synthetase; argininosuccinate synthetase, isoform CRA_b {Homo sapiens} NCBI, Dec. 18, 2006, No Vol., pp. 1-3.

Lee et al., Hepatocyte Gene Therapy in a Large Animal: A Neonatal Bovine Model of Citrullinemia, PNAS, 1999, vol. 96, No #, pp. 3981-3986.

Strausberg et al., National Cancer Institute, Cancer Genome Anatomy Project, Tumor Gene Index, gene accession No. BE136127, 1997 pp. ??.

Lysosomal Acid Lipase (lysosomal acid lipase/ cholesteryl ester hydrolase isoform 1 precursor [Homo sapiens]; NCBI, 2010, No Vol., pp. 1-3.

Du et al., Lysosomal Acid Lipase Deficiency: Correction of Lipid Storage by Adenovirus-Mediated Gene Transfer in Mice; Human Gene Therapy; vol. 13, No #, pp. 1361-1372.

Gu, Minghao et al., Combinatorial synthesis with high throughput discovery of protein-resistant membrane surfaces, BioMaterials, 2013, vol. 34, No#., pp. 6133-6138.

Glucosylceramidase, glucosylceramidase isoform 1precursor [Homo sapiens]; NCBI, 2010, No Vol., pp. 1-4.

Robbins et al., Retroviral Vectors for Use in Human Gene Therapy for Cancer, Gaucher Disease, and Arthritis; Annals of the New York Academy of Sciences, 2006, vol. 716, No. 1, pp. 72-89.

Bertrand, Edouard et al., The snoRNPs and Related Machines: Ancient Devices That Mediate Maturation of rRNA and Other RNAs, 2004, Chapter 13, pp. 223-257.

Zhao, Xiansi et al., Regulation of Nuclear Receptor Activity by a Pseudouridine Synthase through Posttranscriptional Modification of Steroid Receptor RNA Activator, Molecular Cell, 2004, vol. 15, No #, pp. 549-558.

Zhao, Xinliang, Detection and quantitation of RNA base modifications, RNA, 2004, vol. 10:, pp. 996-1002.

Bosma, Piter Jabik et al., Inherited disorders of bilirubin metabolism, Journal of Hepatology, 2003, vol. 38, No #, pp. 107-117.

Chowdhury, Jayanta R. et al., Bilirubin Mono- and Diglucuronide Formation by Human Liver In Vitro: Assay by High-Pressure Liquid Chromatography, Hepatology, 1981, vol. 1, No. 6, pp. 622-627.

Chowdhury, Jayanta R. et al., Molecular Basis for the Lack of Bilirubin-specific and 3-Methylcholanthrene-inducibleU DP-GlucuronosyltransferaseActivities in Gunn Rats, Thej Ournaofl B Iological Chemistry, 1991, vol. 266, No. 27, pp. 18294-18298.

Chowdhury, Namita et al., Isolation of Multiple Normal and Functionally Defective Forms of Uridine Diphosphate-Glucuronosyltransferase from Inbred Gunn Rats, J. Clin. Invest, 1987, vol. 79, No. #, pp. 327-334.

Crigler, John et al. Society Transactions, Society for Pediatric Research, 31st Annual Meeting, Atlantic City, Congenital Familial Nonhemolytic Jaundice with Kernicterus: A New Clinical Entity, 1951, 3rd session, no Vol. pp. 1-3.

Miyagi, Shogo J. et al., The Development of UDP-Glucuronosyltransferases 1A1 and 1A6 in the Pediatric Liver, Drug Metabolism and Disposition, 2011, vol. 39, No. 5, pp. 912-919.

Gunn, Charles, Hereditary Acholuric Jaundice in the Rat, Can M.J., 1944, vol. 50, No #, pp. 230-237.

Brockton, NT et al, UGT1A1 polymorphisms and colorectal cancer susceptibility, Cancer, Gut, 2002; vol. 50, pp. 747-748.

Iyanagi, Takashi et al., Molecular Basis of Multiple UDP-Glucuronosyltransferase Isoenzyme Deficiencies in the Hyperbilirubinemic Rat (Gunn Rat), 1991, vol. 266, No. 35, pp. 24048-24052.

Kadakol, Ajit et al., Genetic Lesions of Bilirubin Uridine-diphosphoglucuronate Glucuronosyltransferase (UGT1A1) Causing Crigler-Najjar and Gilbert Syndromes: Correlation of Genotype to Phenotype, Human Mutation, 2000, vol. 16, No #, pp. 297-306.

Miranda, Paula S. Montenegro et al., Towards Liver-Directed Gene Therapy for Crigler-Najjar Syndrome, Current Gene Therapy, 2009, vol. 9, pp. 72-82.

Pastore, Nunzia et al., Sustained Reduction of Hyperbilirubinemia in Gunn Rats After Adeno-Associated Virus-Mediated Gene Transfer of Bilirubin UDP-Glucuronosyltransferase Isozyme 1A1 to Skeletal Muscle, Human Gene Therapy, 2012, vol. 23, No #, pp. 1082-1089.

Schmitt, Françoise et al., Lentiviral Vectors That Express UGT1A1 in Liver and Contain miR-142 Target Sequences Normalize Hyperbilirubinemia in Gunn Rats, Gastroenterology, vol. 139, No #,pp. 999-1007, 2010.

Strassburg, Christian P. et al., Hyperbilirubinemia syndromes (Gilbert-Meulengracht, Crigler-Najjar, Dubin-Johnson, and Rotor syndrome), Best Practice & Research Clinical Gastroenterology, 2010, vol. 24, No. #, pp. 555-571.

Sugatani, Junko et al., Transcriptional Regulation of Human UGT1A1 Gene Expression: Activated Glucocorticoid Receptor Enhances constitutive Androstane Receptor/ Pregnane X Receptor-Mediated UDP-Glucuronosyltransferase 1A1 Regulation with Glucocorticoid Receptor-Interacting Protein 1, Molecular Pharmacology, 2013, vol. 67, No. 3, pp. 845-855.

Batshaw, Mark L. et al., Treatment of Inborn Errors of Urea Synthesis, The New England Journal of Medicine, 1982, vol. 306, No. 23, pp. 1387-1392.

Batshaw, Mark L. Et al., Risk of Serious Illness in Heterozygotes for Ornithine Transcarbamylase Deficiency, J. Pediatr, 1986, vol. 108, No. 2, pp. 236-241.

Braissant, Olivier et al., Current concepts in the pathogenesis of urea cycle disorders, Molecular Genetics and Metabolism, 2010, vol. 100, pp. S3-S12.

Hodges, Peter E. et al., The spf h mouse: A missense mutation in the ornithine transcarbamylase gene also causes aberrant mRNA splicing, Genetics, Proc. Nati. Acad. Sci. USA, 1989,vol. 86, pp. 4142-4146.

Marini, Juan C et al., Phenylbutyrate improves nitrogen disposal via an alternative pathway without eliciting an increase in protein breakdown and catabolism in control and ornithine transcarbamylase-deficient patients, Am J Clin Nutr , 2011, vol. 93, No. #, pp. 1248-1254.

Rosenberg, Leon E., et al., Biogenesis of Ornithine Transcarbamylase in sprsh Mutant Mice: Two Cytoplasmic Precursors, One Mitochondrial Enzyme, Science,1983, vol. 222, No Vol. #, pp. 426-428.

Summar, MD, Marshall et al., Current strategies for the management of neonatal urea cycle disorders, The Journal of Pediatrics, 2001, vol. 138, No. 1, pp. s30-s39.

Walker, V., Ammonia toxicity and its prevention in inherited defects of the urea cycle, Diabetes, Obesity and Metabolism, 2009, vol. 11, No #, pp. 823-835.

(56) References Cited

OTHER PUBLICATIONS

Whitington, P. F. et al., Liver transplantation for the treatment of urea cycle disorders, J. Inher. Metab. Dis., 1998, vol. 21 (Suppl 1) pp. 112-118.
Wilcken, Bridget et al., Problems in the management of urea cycle disorders, Molecular Genetics and Metabolism, 2004, vol. 81, No #, S86-S91.
Cosman, David et al., ULBPs, Novel MHC Class I-Related Molecules, Bind to CMV Glycoprotein UL16 and Stimulate NK Cytotoxicity through the NKG2D Receptor, Immunity,2001, vol. 14, No Vol. pp. 123-133.
Croft, Michael et al., TNF superfamily in inflammatory disease: translating basic insights, Trends Immunol, 2012; vol. 33, No. 3, pp. 144-152.
Friese, Manuel A. et al., MICA/NKG2D-Mediated Immunogene Therapy of Experimental Gliomas, Cancer Res, 2003, vol. 63, pp. 8996-9006.
Gomes, Anita Q. et al., Non-classical major histocompatibility complex proteins as determinants of tumour immunosurveillance, 2007, EMBO reports, vol. 8, No. 11, pp. 1024-1030.
Guo, Z Sheng et al., Life after death: targeting high mobility group box 1 in emergent cancer therapies, Am J Cancer Res, 2013;vol. 3, No. 1 pp. 1-20.
Kane, Lawrence P. et al., TIM Proteins and Immunity, J Immunol., 2010; vol. 184, No. (6): 2743-2749.
Lanca, Telma et al., The MHC class Ib protein ULBP1 is a nonredundant determinant of leukemia/lymphoma susceptibility to gd T-cell cytotoxicity, Blood, 2010, vol. 115, No #, pp. 2407-2411.
Lee, Sylvia et al., Cytokines in Cancer Immunotherapy , Cancers, 2011, vol. 3, No. #, pp. 3856-3893.
Lee, Judong et al., TIM Polymorphisms—Genetics and Function, Genes Immun. 2011, vol. 12, No. 8, pp. 595-604.
Raghavan, Malini et al., Calreticulin in the immune system: ins and outs, Cell Press, Trends in Immunology, 2013, vol. 34, No. 1, pp. 13-21.
Shin, Jae Hun et al., Positive conversion of negative signaling of CTLA4 potentiates anti-tumor efficacy of adoptive T cell therapy in murine tumor models, Blood, 2012, No Vol. , pp. 1-29.
Sutherland, Claire L. et al., ULBPs, human ligands of the NKG2D receptor, stimulate tumor immunity with enhancement by IL-15, 2006, vol. 108, No #, pp. 1313-1319.
Wang, Haichao et al., HMG-1 as a Late Mediator of Endotoxin Lethality in Mice, Science, 1999, vol. 285, No. 284, pp. 248-251.
Bikard, David et al., Programmable repression and activation of bacterial gene expression using an engineered CRISPR-Cas system, Nucleic Acids Research Advance, 2013, No Vol. 190 , pp. 1-9.
Le Cong et al., Multiplex Genome Engineering Using CRISPR/Cas Systems, Science, 2013, vol. 339, No. 819, pp. 819-823.
Ornithine Carbamoyltransferase; ornithine carbamoyltransferase, mitochondrial precursor [*Homo sapiens*}; NCBI, 2010, No Vol., pp. 1-3.
Kiwaki et al., Correction of Ornithine Transcarbamylase Deficiency in Adult spfash Mice and in OTC-Deficient Human Hepatocytes with Recombinany Adenoviruses Bearing the CAG Promoter; Human Gene Therapy, 1996, vol. 7, No #, pp. 821-830.
Hwang, Woong Y et al., Efficient genome editing in zebrafish using a CRISPR-Cas system, Nature Biotechnology, 2013, No Vol. pp. 1-3.
International Search Report, PCT/US2013/75177, dated May 5, 2014, pp. 1-20.
Robbins, Majorie et al., 2'-O-methyl-modified RNAs Act as TLR7 Antagonists, Molecular Therapy, 2007, vol. 15, No. 9, pp. 1663-1669.
Kandimalla, Ekambar R. et al.Design, synthesis and biological evaluation of novel antagonist compounds of Toll-like receptors 7, 8 and 9, Nucleic Acids Research, 2013, vol. 41, No. 6, pp. 3947-3961.
Hochreiter-Hufford, Amelia et al., And Digestion Clearing the Dead: Apoptotic Cell Sensing, Recognition, Engulfment, Cold Spring Harb Perspect Biol, 2013, No Vol #, pp. 1-20.

Kim, Sunjung et al, Transcriptional Suppression of Interleukin-12 Gene Expression following Phagocytosis of Apoptotic Cells, Immunity, 2004, vol. 21, No #, pp. 643-653.
Broz, Petr et al., Newly described pattern recognition receptors team up against intracellular pathogens, Nature Reviews, Immunology, 2013, vol. 13, No. #, pp. 551-565.
Bonham, Kevin S. et al., A Promiscuous Lipid-Binding Protein Diversifies the Subcellular Sites of Toll-like Receptor Signal Transduction, Cell, 2014, vol. 156, No #, pp. 705-716.
Ravichandran, Kodi S., Find-me and eat-me signals in apoptotic cell clearance: progress and conundrums, JEM, 2010, vol. 207, pp. 1807-1817.
Stuart, Lynda M. et al., Cell Maturation upon Endotoxin-Driven Myeloid Dendritic Inhibitory Effects of Apoptotic Cell Ingestion, The Journal of Immunology, 2002, vol. 168, No #, pp. 1627-1635.
Wallet, Mark A et al., Immunoregulation of Dendritic Cells, Clinical Medicine & Research, 2005, Vo. 3, No. 3, pp. 166-175.
Williams, Charlotte A. et al, Apoptotic cells induce dendritic cell-mediated suppression via interferon-c-induced IDO, Immunology, 2007, vol. 124, No #, pp. 89-101.
Keegan, Liam P. et al., The Many Roles of an RNA Editor, Nature Reviews, Genetics, 2001, vol. 2, No #, pp. 869-878.
Felden, Brice et al., Presence and location of modified nucleotides in *Escherichia coli*t mRNA: structural mimicry with tRNA acceptor branches, The EMBO Journal, 1998, vol. 17 No. 11 pp. 3188-3196.
Doffek, Kara et al., Phosphatidyserine Inhibits NFkB and p38 MAPK Activation in Human Monocyte Derived Dendritic Cells, Molecular Immunology, 2011, vol. 48, No. #, pp. 1771-1777.
Oberg (Aquaporins, Production Optimization and Characterization; Thesis for the Degree of Doctor of Philosophy in Natural Science; University of Gothenburg, Department of Chemistry—Biochemistry; pp. 1-69, published May 27, 2011. No Vol.
by hAQP5 (*Homo sapiens* aquaporin 5 (AQP5) mRNA; NCBI, pp. 1-5, published Dec. 27, 2010, No. Vol.
Iduronate 2-Sulfatase: iduronate 2-sulfatase isofirm a preproprotien [*Homo sapiens*], NCBI, 2010, No Vol., pp. 1-4.
European Supplementary Search Report, EP11815407, Jun. 13, 2014, pp. 1-13.
Bermudez et al., Treatment with Recombinant Granulocyte Colony-stimulating Factor (Filgrastin) Stimulates Neutrophils and Tissue /macrophages and Induces an Effective non-specific Response Against *Mycobacterium avium* in Mice, Imnnunology,1998, vol. 94, No. 3, pp. 297-303.
Sheridan, W. et al., Effects of Peripheral-Blood Progenitor Cells Mobilised by Filgrastim (G-CSF) on Platelet Recovery After High-Dose Chemotherapy, The Lancet, 1992, vol. 339, pp. 640-644.
Alpha Galactosidase A; alpha-galactosidase A precursor [ *Homo sapiens*] NCBI, 2010, pp. 1-4.
Ziegler et al., AAV2 Vector Harboring a Liver-Restricted Promoter Facilates Sustained Expression of Therapeutic Levels of a-Galactosidase A and the Induction of Immune Tolerance in Fabry Mice, Molecular Therapy, 2004, vol. 9, No. 2, pp. 231-240.
International Search Report from International Application No. PCT/US2012/068714, dated Aug. 6, 2013.
Iduronate 2-Sulfatase; iduronate 2-sulfatase isofrom a preproprotein [ *Homo sapiens*]; NCBI, 2010, pp. 1-4.
Braun et al., Preclinical Studies of Lymphocyte Gene Therapy for Mild Hunter Syndrome (Mucopolysaccharidosis Type II); Human Gene Therapy, 1996, Vol. , No #, pp. 283-290.
Desmond Padhi et al., Single-Dose, Placebo-Controlled, Randomized Study of AMG 785, a Sclerostin Monoclonal Antibody, Journal of Bone and Mineral Research, vol. 26, No. 1, 2011, pp. 19-26.
Yu, Alice et al, Anti-GD2 Antibody with GM-CSF, Interleukin-2, and Isotretinoin for Neuroblastoma,The New England Journal of Medicine, 2010, vol. 363; No. 14, pp. 1324-1334.
Carboxypeptidas N, Carboxypeptidas N caralytic Chanin precursor [*Homo sapiens*] NCBI, 2010, pp. 1-4.
US 20020198163, 12/2002, Felgner et al. (withdrawn).
Abuchowski, A. et al., Immunosuppressive properties and circulating life of Achromobacter glutaminase asparaginase covalently attached to polyethylene glycol in man. Cancer Treat Rep. Nov.-Dec. 1981;65(11-12):1077-81.

(56) References Cited

OTHER PUBLICATIONS

Abuchowski, A. et al., Reduction of plasma urate levels in the cockerel with polyethylene glycol-uricase. J Pharmacol Exp Ther. Nov. 1981;219(2):352-4.

Aduri, R., et al., AMBER force field parameters for the naturally occurring modified nucleosides in RNA. J Chem Theory Comput. 2007; 3: 1464-1475.

Agaisse, H. et al., STAB-SD: a Shine-Dalgarno sequence in the 5' untranslated region is a determinant of mRNA stability. Mol Microbiol. May 1996;20(3):633-43.

Aissani, B. et al., CpG islands, genes and isochores in the genomes of vertebrates. Gene. Oct. 15, 1991;106(2):185-95.

Akashi, H., Gene expression and molecular evolution. Curr Opin Genet Dev. Dec. 2001;11(6):660-666.

Aksenova, N.N. et al., Influence of ribonucleic acids from the liver on implantation and growth of transplantable tumours. Nature. Nov. 3, 1962;196:443-4.

Alberts, et al., Molecular Biology of the Cell, 3rd ed. Garland Publishing, Inc. New York, NY, 1994, pp. 368-369.

Aleku, M., et al., Atu027, a liposomal small interfering RNA formulation targeting protein kinase N3, inhibits cancer progression. Cancer Res. 2008; 68: 9788-9798.

Anderson, B.R., et al., Nucleoside modifications in RNA limit activation of 2'-5'-oligoadenylate synthetase and increase resistance to cleavage by Rnase L. Nucleic Acids Res. 2011; pp. 1-10.

Anderson, D.M. et al., Stability of mRNA/cationic lipid lipoplexes in human and rat cerebrospinal fluid: methods and evidence for nonviral mRNA gene delivery to the central nervous system. Hum Gene Ther. Feb. 10, 2003;14(3):191-202.

Andrews-Pfannkoch, C. et al., Hydroxyapatite-mediated separation of double-stranded DNA, single-stranded DNA, and RNA genomes from natural viral assemblages. pl Environ Microbiol. Aug. 2010;76(15):5039-45. Epub Jun. 11, 2010.

Andries, O., et al., Comparison of the gene transfer efficiency of mRNA/GL67 and pDNA/GL67 complexes in respiratory cells. Mol Pharmaceutics. 2012; 9: 2136-2145.

Anichini, A. et al., Cytotixic T cells directed to tumor antigens not expressed on normal melanocytes dominate HLA-A2.1-restricted immune repertoire to melanoma. J Immunol. Jan. 1, 1996;156(1):208-17.

Aota, S. et al., Diversity in G+C content at the third position of codons in vertebrate genes and its cause. Nucleic Acids Res. Aug. 26, 1986;14(16):6345-55.

Apostolopoulos, V. et al., Cellular mucins: targets for immunotherapy. Crit Rev Immunol. 1994;14(3-4):293-309.

Archer, S.J., Induction of a T-cell specific antigen on bone marrow lymphocytes with thymus RNA. Immunology Jan. 1978;34(1):123-9.

Ashley, D.M. et al., Bone marrow-generated dendritic cells pulsed with tumor extracts or tumor RNA induce antitumor immunity against central nevrous system tumors. J Exp Med. Oct. 6, 1997;186(7):1177-82.

Ast, G., How did alternative splicing evolve? Nat Rev Genet. Oct. 2004;5(10):773-82.

Aurup, H. et al., Translation of 2'-modified mRNA in vitro and in vivo. Nucleic Acids Res. Nov. 25, 1994;22(23):4963-8.

Austyn, J.M. et al., New insights into the mobilization and phagocytic activity of dendritic cells. J Exp MNed. Apr. 1, 1996;183(4):1287-92.

Babich, F.R. et al., Cross-species transfer of learning: effect of ribonuclec acid from hamsters on rat behavior. Proc Natl Acad Sci U S A. Nov. 1965;54(5):1299-302.

Bachellerie, J.P. et al., Antisense snoRNAs: a family of nucleolar RNAs with long complementarities to rRNA. Trends Biochem Sci. Jul. 1995;20(7):261-4.

Bag, J., Recovery of normal protein synthesis in heat-shocked chicken myotubes by liposome-mediated transfer of mRNAs. Can. J. Biochem. Cell Biol. 1985: 63(3): 231-235.

Bagnall, et al., Rat strain difference on performance in the Morris water maze. Animal Technology. 1999. 50(2):69-77.

Baker, D.L., et al., RNA-guided RNA modification: functional organization of the archaeal H/ACA RNP. Genes Dev. May 15, 2005;19(10):1238-48. Epub May 3, 2005.

Bakker, J.M. et al, Therapeutic antibody gene transfer: an active approach to passive immunity. Mol Ther. Sep. 2004;10(3):411-6.

Balakin, A.G. et al., The RNA world of the nucleolus: two major families of small RNAs defined by different box elements with related functions. Cell. Sep. 6, 1996:86(5):823-34.

Bandbon Balenga, N.A. et al., Bicistronic expression plasmid encoding allergen and anti-IgE single chain variable fragment antibody as a novel DNA vaccine for allergy therapy and prevention. Med Hypotheses. 2006;67(1):71-4. Epub Mar. 2, 2006.

Banerjee, A.K., 5'-terminal cap structure in eucaryotic messenger ribonucleic acids. Microbiol Rev. Jun. 1980;44(2):175-205.

Barber, R., The chromatographic separation of ribonucleic acids. Biochim Biophys Acta. Feb. 21, 1966;114(2):422-4.

Bargmann, C.I. et al., The neu oncogene encodes an epidermal growth factor receptor-related protein. Nature. Jan. 16-22, 1986;319(6050):226-30.

Barlow, P.G., et al., The human cathelicidin LL-37 preferentially promotes apoptosis of infected airway epithelium. Am J Respir Cell Mol Biol. Dec. 2010; 43(6): 692-702.

Basarkar, A. et al., Nanoparticulate systems for polynucleotide deliver. Int J Nanomedicine. 2007; 2(3): 353-360.

Basha, G. et al., Influence of cationic lipid composition on gene silencing properties of lipid nanoparticle formulations of siRNA in antigen-presenting cells. Mol Ther. Dec. 2011; 19(12): 2186-2200.

Bechler, K., Influence of capping and polydenylation on mRNA expression and on antisense RNA mediated inhibition of gene expression. Biochem Biophys Res Commun. Dec. 8, 1997;241(1):193-9.

Beljanski, et al., Iron stimulated RNA-dependent DNA polymerase activity from goldfish eggs. Cell Mol Biol. 1988;34(1):17-25.

Belliveau, N.M., et al., Microfluidic synthesis of highly potent limit-size lipid nanoparticles for in viro delivery of siRNA. Mol Ther Nucleic Acids. Aug. 2012; 1(8): e37.

Bernardi, G. et al., The vertebrate genome: isochores and evolution. Mol Biol Evol. Jan. 1993;10(1):186-204.

Bernhard, H. et al., Generation of immunostimulatory dendritic cells from human CD34+ hematopoietic progenitor cells of the bone marrow and peripheral blood. Cancer Res. Mar. 1, 1995;55(5):1099-104.

Bernstein, E. et al., Role for a bidentate ribonuclease in the initiation step of RNA interference. Nature Jan. 18, 2001;409(6818):363-6.

Bernstein, P. et al., Poly(A), poly(A) binding protein and the regulation of mRNA stability. Trends Biochem Sci. Sep. 1989;14(9):373-7.

Bertolini, M.C., et al., Fractionation of immune RNA isolated from the spleens of mice infected with Trypanosoma cruz. J Infect Dis. Jun. 1981;143(6):827-31.

Bertolini, In vitro effect of 18S immune RNA on macrophage resistance to Trypanosoma cruzi. Cell Mol Biol. 1986;32(2):167-71.

Bertolini, The protective effect of the 4-5S immune RNA against Trypanosoma cruzi infection in mice. Trop Med Parasitol. Sep. 1985;36(3):131-4.

Bertrand, E. et al., Assembly and traffic of small nuclear RNPs. Prog Mol Subcell Biol. 2004;35:79-97.

Bettinger, T. et al., Peptide-mediated RNA delivery: a novel approach for enhanced transfection of primary and post-mitotic cells. Nucleic Acids Res. Sep. 15, 2001;29(18):3882-91.

Bevan, M.J. et al., Antigen presentation to cytototix T lymphocytes in vivo. J Exp Med. Sep. 1, 1995;182(3):639-41.

Bevilacqua, A. et al., Post-transcriptional regulation of gene expression by degradation of messenger RNAS. J Cell Physiol. Jun. 2003;195(3):356-72.

Bieler, K. et al., Plasmids for Therapy and Vaccination. Wiley-VCH GmbH. Weinheim, Feb. 2001.

Kariko, K. et al., Incorporation of pseudouridine into mRNA yields superior nonimmunogenic vector with increased translational capacity and biological stability. Mol Ther. Nov. 2008;16(11):1833-40. Epub Sep. 16, 2008.

(56) References Cited

OTHER PUBLICATIONS

Kariko, K. et al., Phosphate-enhanced transfection of cationic lipid-complexed mRNA and plasmid DNA. Biochim Biophys Acta. Mar. 2, 1998;1369(2):320-34.
Kariko, K., et al., In vivo protein expression from mRNA delivered into adult rat brain. J. of Neuroscience Methods. Jan. 2001; 105(1): 77-86.
Kariko, K. et al., mRNA is an endogenous ligand for Toll-like receptor 3. J Biol Chem. Mar. 26, 2004;279(13):12542-50. Epub Jan. 16, 2004.
Kariko, K. et al., Suppression of RNA recognition by Toll-like receptors: the impact of nucleoside modification and the evolutionary origin of RNA. Immunity. Aug. 2005;23(2):165-75.
Kariko, K., et al., Increased erythropoiesis in mice injected with submicrogram quantities of pseudouridine-containing mRNA encoding erythropoietin. Mol Ther. May 2012; 20(5): 948-853.
Karlin, S. et al., Applications and statistics for multiple high-scoring segments in molecular sequences. Proc Natl Acad Sci U S A. Jun. 15, 1993;90(12):5873-7.
Katre, N.V. et al., Chemical modification of recombinant interleukin 2 by polyethylene glycol increases its potency in the murine Meth A sarcoma model. Proc Natl Acad Sci U S A. Mar. 1987;84(6):1487-91.
Katz, N., et al., Rapid onset of cutaneous anesthesia with EMLA cream after pretreatment with a new ultrasound-emitting device. Anesth Analg. 2004; 98: 371-376.
Kawai, T., et al., Antiviral signaling through pattern recognition receptors, J. Biochem. 2007; 141(2): 137-145.
Kawamura, T., et al., Linking the p53 tumor suppressor pathway to somatic cell reprogramming. Nature. Aug. 2009; 460(7259): 1140-1144.
Kazmierczak, K.M. et al., The phage N4 virion RNA polymerase catalytic domain is related to single-subunit RNA polymerases. EMBO J. Nov. 1, 2002;21(21):5815-23.
Keith, B., et al., HIF1a and HIF1a: sibling rivairy in hypoxic tumor growth and progression. Nat Rev Cancer. Jul. 2012; 12(1): 9-22.
Keller, E.B. et al., Intron splicing: a conserved internal signal in introns of animal pre-mRNAs. Proc Natcl Acad Sci U S A. Dec. 1984;81(23):7417-20.
Keown, W.A., et al., [41] Methods for Introducing DNA into Mammalian Cells Methods in Enzymology, 1990, 185:527-37.
Keshishian, H., et al., Quantification of cardiovascular biomarkers in patient plasma by targeted mass spectrometry and stable isotope dilution. Mol Cell Proteomics. Oct. 2009; 8(10): 2339-2349.
Kesselheim, A.S., An empirical review of major legistation affecting drug developmement: Past experiences, effects, and unintended consequences. The Milbank Quarterly. 2011; 89(3): 450-502.
Khare, P.D. et al., Tumor growth suppression by a retroviral vector displaying scFv antibody to CEA and carrying the iNOS gene. Anticancer Res. Jul.-Aug. 2002;22(4):2443-6.
Khullar, N. et al., Comparative evaluation of the protective effect of immune spleen cells and immune RNA against Plasmodium berghei. Ann. Trop. Med. Parasitol., 1988, 82(6):519-26.
Kim, C.H. et al., Codon optimization for high-level expression of human erythropoietin (EPO) in mammalian cells. Gene. Oct. 15, 1997;199(1-2):293-301.
Kim, D., et al., Generation of human induced pluripotent stem cells by direct delivery of reprogramming proteins. Cell Stem Cell. Jun. 2009; 4(6): 472-476.
Kim, S.H., et al., Opsonized erythrocyte ghosts for liver-targeted delivery of antisense oligodeoxynucleotides. Biomaterials. Feb. 2009; 30(5): 959-967. Epub Nov. 22, 2008.
Kines, R.C. et al., The initial steps leading to papillomavirus infections occur on the basement membrane prior to cell surface binding. PNAS. Dec. 1, 2009; 106(48): 20458-20463.
Kinosita, K. Jr. et al., Formation and resealing of pores of controlled sizes in human erythrocyte membrane. Nature. Aug. 4, 1977;268(5619):438-41.
Kirby, K.S., A New Method for the Isolation of Ribonucleic Acids from Mammalian Tissues. J. Biochem., 1956, 64:405.
Kirshenbaum, et al., Designing polymers that mimic biomolecules. Curr Opin Struct Biol. 1999. 9:530-5.
Kirpotin, D.B., et al., Antibody targeting of long-circulating lipidic nanoparticles does not inceease tumor localization but does increase internalization in animal models. Cancer Res. 2006; 66: 6732-6740.
Kiss, T., Small nucleolar RNA-guided post-transcriptional modification of cellular RNAs. EMBO J. Jul. 16, 2001;20(14):3617-22.
Kiss, T., Small nucleolar RNAs: an abundant group of noncoding RNAs with diverse cellular functions. Cell. Apr. 19, 2002;109(2):145-8.
Kitaguchi, K. et al., Immune deficiency enhances expression of recombinant human antibody in mice after nonviral in vivo gene transfer. Int J Mol Med. Oct. 2005;16(4):683-8.
Klinman, D.M. et al., DNA vaccines: safery and efficacy issues. Springer Semin Immunopathol. 1997;19(2)2:245-56.
Koch, G. and Bishop, J.M. The effect of polycations on the interaction of viral RNA with mammalian cells: Studies on the infectivity of single- and double-stranded poliovirus RNA. Virology. May 1968; 35(1): 9-17.
Koch, G., et al., Quantitative Studies on the Infectivity of ribonucleic acid from partially purified and high purified poliovirus preparations, Virology. Mar. 1960; 10(3): 329-343.
Koch, G., et al., An agar cell-suspension plaque assay for isolated viral RNA. Biochem and Biophys Res. Comm. 1966; 24(3): 304-309.
Kohler, G. et al., Continuous cultures of fused cells secreting antibody of predefined specificity. Nature. Aug. 7, 1975;256(5617):495-7.
Koide, Y. et al., DNA vaccines. Jpn J Pharmacol. Jul. 2000;83(3):167-74.
Koido, S. et al., Induction of antitumor immunity by vaccination of dendritic cells tranfected with MUC1 RNA. J. Immunol. Nov. 15, 2000;165(10):5713-9.
Kolb, A.F. et al., A virus-neutralising antibody is not cytotoxic in vitro. Mol Immunol. Feb. 2006;43(6):677-89.
Komar, A.A. et al., Synonymous codon substitutions affect ribosome traffic and protein folding during in vitro translation. FEBS Lett. Dec. 3, 1999;462(3):387-91.
Kontermann, R.E. et al., Recombinant bispecific antibodies for cancer therapy. Acta Pharmacol Sin. Jan. 2005;26(1):1-9.
Korsten, K.H. et al., The strategy of infection as a criterion for phylogenetic relationships of non-coli phages morphologically similar to phage T7. J Gen Virol. Apr. 1979;43(1):57-73.
Koski, G.K. et al., Cutting edge innate immune system discriminates between RNA containing bacterial versus eukaryotic structural features that prime for high-level IL-12 secretion by dendritic cells. J Immunol. Apr. 1, 2004;172(7):3989-93.
Krieg, P.A. et al., Functional messenger RNAs are produced by SP6 in vitro transcription of cloned cDNAs. Nucleic Acids Res. Sep. 25, 1984;12(18):7057-70.
Krieg, P.A. et al., In vitro RNA synthesis with SP6 RNA polymerase. Methods Enzymol. 1987;155:397-415.
Kreiter, S., et al., Intranodal vaccination with naked antigen-encoding RNA elicits potent prophylactic and therapeutic antitumoral immunity. Cancer Res. 2010; 70: 9031-9040.
Kreiter, S., et al., Tumor vaccination using messenger RNA: prospect of a future therapy. Curr Opinion in Immun. Jun. 23, 2011(3): 399-406.
Kudla, G. et al., High guanine and cytosine content increases mRNA levels in mammalian cells. PLoS Biol. Jun. 2006;4(6):e180. Epub May 23, 2006.
Kufe, D.W. et al., Holland-Frei cancer medicine, 6th edition. Hamilton (ON): BC Decker; 2003; Table 12-1.
Kugler, A. et al., Regression of human metastatic renal cell carcinoma after vaccination with tumor cell-dendritic cell hybrides. Nat Med. Mar. 2000;6(3):332-6.
Kuhn, A.N., et al., mRNA as a versatile tool for exogenous protein expression. Current Gene Therapy. Oct. 2012; 12(5): 347-361.
Nakamura, K. et al.,The proliferation of plasma cells from mouse bone marrow in vitro. III. Primary and secondary immune responses associated with thymic RNA. Immunol Commun. 1979;8(5-6):511-29.

(56) References Cited

OTHER PUBLICATIONS

Nakamura, K., The proliferation of plasma cells from mouse bone marrow in vitro. II-Stimulation of IgG-producing cells by a RNase-sensitive thymocyte homogenate. Cell Immunol. Aug. 1976:25(2):163-77.

Nallagatla, S.R. et al., A brilliant disguise for self RNA: 5'-end and internal modifications of primary transcripts suppress elements of innate immunity. RNA Biol. Jul.-Sep. 2008;5(3):140-4. Epub Jul. 20, 2008.

Narayanan, A. et al., Role of the box C/D motif in localization of small nucleolar RNAs to coiled bodies and nucleoli. Mol Biol Cell. Jul. 1999;10(7):2131-47.

Naz, R.K. et al., Novel human prostate-specific cDNA: molecular cloning, expression, and immunobiology of the recombinant protein. Biochem Biophys Res Commun. Oct. 11, 2002;297(5):1075-84.

Needleman, S.B. et al., A general method applicable to the search for similarities in the amino acid sequence of two proteins. J Mol Biol. Mar. 1970;48(3):443-53.

Nestle, F.O. et al., Vaccination of melanoma patients with peptide- or tumor lysate-pulsed dendritic cells. Nat Med. Mar. 1998;4(3):328-32.

Neumann, E. et al., Fundamentals of electroporative delivery of drugs and genes. Bioelectrochem Bioenerg. Feb. 1999;48(1):3-16.

Newby, M.I. et al., Sculpting of the spliceosomal branch site recognition motif by a conserved pseudouridine. Nat Struct Biol. Dec. 2002;9(12):958-65.

Newman, A. et al., Mutations in yeast U5 snRNA alter the specificity of 5' splice-site cleavage. Cell. Apr. 5, 1991;65(1):115-23.

Newman, A.J. et al., U5 snRNA interacts with exon sequences at 5' and 3' splice sites. Cell. Feb. 21, 1992;68(4):743-54.

Newmark, J. et al., Preparation and properties of adducts of streptokinase and streptokinase-plasmin complex with poly ethylene glycol and pluronic polyol F38. J Appl Biochem. 1982; 4:185-9.

Ni, J. et al., Small nucleolar RNAs direct site-specific synthesis of pseudouridine in ribosomal RNA. Cell. May 16, 1997;89(4):565-73.

Nicholson, A.W. et al., Accurate in vitro cleavage by RNase III of phosphorothioate-substituted RNA processing signals in bacteriophage T7 early mRNA. Nucleic Acids Res. Feb. 25, 1988;16(4):1577-91.

Nielsen, D.A. et al., Preparation of capped RNA transcripts using T7 RNA polymerase. Nucleic Acids Res. Jul. 25, 1986;14(14):5936.

Nielsen, P.E., Peptide nucleic acids as therapeutic agents. Curr Opin Struct Biol. Jun. 1999;9(3):353-7.

Nikolin, V.P. et al., Resistance of Mice Exposed to Whole-Body Irradiation to Transplanted Hemopoietic Cells Modified with RNA Preparations. Bull. Exp. Biol. Med., 2000, 129:5571-4.

Niu, M.C. et al., Genetic Manipulation in Higher Organisms; III. Detection of Soya Protein in Seeds Derived from Soya mRNA-Treated Rice. Scientia Sinica. 1980, 23:119-23.

Niu, M.C. et al., Ribonucleic acid-induced changes in mammalian cells. Proc Natl Acad Sci U S A. Oct. 15, 1961;47:1689-700.

Matsuda, A. et al., Nucleosides. 120. Synthesis of 2'-Deoxy-?-isocytidine and 2'-Deoxy-1-methyl-?-uridine from ?-Uridine^ 1. J Org Chem. 1981; 46:3603-3609.

Matsuda, A. et al., Synthesis of 3-Methylpseudouridine and 2'-Deoxy-3-Methyl-pseudouridine. Carbohydr Res. Mar. 1, 1982; 100: 297-302.

Bhattacharya, B.K. et al., A practical synthesis of N1-Methyl-2'-deoxy-?-uridine (?-Thymidine) and its incorporation into G-rich triple helix forming oligonucleotides. Nucleosides & Nucleotides. 1995; 14(6): 1269-1287.

Desaulniers, J.P. et al., Synthesis of 15N-enriched pseudouridine derivatives. Org Lett. Oct. 30, 2003; 5(22): 4093-4096.

Jachertz, D. et al., Treatment of P815 mastocytoma in DBA/2 mice with RNA. J Immunogen. 1974; 1: 355-362.

McGary, E.C. et al., Post-transcriptional regulation of erythropoietin mRNA stability by erythropoietin mRNA-binding protein. J Biologic Chem. Mar. 28, 1997; 272(13): 8628-8634.

Hornung, V. et al., 5'-triphosphate RNA is the ligand for RIG-I. Science. Nov. 10, 2006; 314(5801): 994-997.

Davis, D.R. Stabilization of RNA stacking by pseudouridine. Nucleic Acids Res. 1995; 23(24): 5020-5026.

Monobe, M. et al., Beta-pseudouridine, a beer component, reduces radiation-induced chromosome aberrations in human lymphocytes. Mutat Res. Jul. 8, 2003; 538(1-2): 93-99.

Hanessian, S. et al., A highly stereocontrolled and efficient synthesis of alpha- and beta-pseudouridines. Tetrahedron Letters. 2003; 44: 8321-8323.

Shi, Y. et al., Identification and characterization of pancreatic eukaryotic initiation factor 2 alpha-subunit kinase, PEK, involved in translational control. Mol Cell Biol. Dec. 1998; 18(12): 7499-7509.

Nguyen, A. et al., Quantitative assessment of the use of modified nucleoside triphosphates in expression profiling: differential effects on signal intensities and impacts on expression ratios. BMC Biotechnol. Jul. 31, 2002; 2:14.

Carrington, J.C. et al., Cap-independent enhancement of translation by a plant potyvirus 5' nontranslated region. J Virol. Apr. 1990; 64(4): 1590-1597.

Gallie, D. R. The 5'-leader of tobacco mosaic virus promotes translation through enhanced recruitment of eIF4F. Nuc Acids Res. 2002; 30(15): 3401-3411.

Decatur, W. A. et al., RNA-guided nucleotide modification of ribosomal and other RNAs. J Biologic Chem. Jan. 10, 2003; 278(2): 695-698.

Badis, G. et al., A snoRNA that guides the two most conserved pseudouridine modifications within rRNA confers a growth advantage in yeast. RNA. Jul. 2003; 9(7): 771-779.

Nitin, N. et al., Peptide-linked molecular beacons for efficient delivery and rapid mRNA detection in living cells. Nuc Acids Res. 2004; 32(6): e58.

Cho, E.J. et al., mRNA capping enzyme is recruited to the transcription complex by phosphorylation of the RNA polymerase II carboxy-terminal domain. Genes Dev. Dec. 15, 1997; 11(24): 3319-3326.

Santi, D.V. Mechanistic studies of RNA modifying enzymes. RNA pseudouridine synthase and m5Cytosine methyl transferase. Nucleic Acids Symp Ser. 2000; 44: 147-148.

Strobel, I. et al., Human dendritic cells transfected with either RNA or DNA encoding influenza matrix protein M1 differ in their ability to stimulate cytotoxic T lymphocytes. Gene Ther. Dec. 2000; 7(23): 2028-2035.

Takahashi, T.T. et al., mRNA display: ligand discovery, interaction analysis and beyond. Trends in Biochem Sci. Mar. 2003; 28(3): 159-165.

Niu, M.C. et al., The Developmental Potentiality of the Liver-RNA-Treated Posterior Primitive Streak in the Chick Embryo. Biol. Bull, 1968, 135:200-7.

Niu, M.C. et al., The Entrance of Exogenous RNA into the Mouse Ascites Cell. Proc. Soc. Exp. Biol. Med., 1968, 128 (2):550-5.

Niu, M.C., RNA-Induced Biosynthesis of Specific Enzymes. PNAS, 1962, 48:1964-9.

Niu, M.C., Antagonistic Action of Exogenous Histone and RNA in Mouse Ascites Cells. Proc. Soc. Exp. Biol. Med., 1972, 140:256-62.

Niu, M. C., Causal Analysis of Embryonic Differentiation; I. Responsiveness of Presumptive Ectoderm as a Regulating Factor in RNA Function. Exp. Cell Res., 1971, 64:57-64.

Niu, M.C., Causal Analysis of Embryonic Differentiation; II. Dual Function of Exogenous RNA in differentiation of Presumptive Ectoderm. Exp. Cell Res., 1971, 64:65-76.

Niu, M.C., Current Evidence Concerning Chemical Inducers. Evolution of Nervous Control from Primitive Organisms. 1959, 7-30.

Niu, M.C., Functional Potentiality of Ribonucleic Acid. Acta. Unio. Int. Contra. Cancrum, third meeting Philadelphia, 1964, 20:995-6.

Niu, M.C., Genetic manipulation in higher organisms; I. Goldfish ova as materials of operation, mRNA mediated alteration of the liver specific isozymes. Scientia Sinica, 1977, 20(6):803-8.

Ma, B. et al., HPV pseudovirions as DNA delivery vehicles. Ther Deliv. Apr. 2011; 2(4): 427-430.

(56) References Cited

OTHER PUBLICATIONS

Samarsky, D.A. et al., The snoRNA box C/D motif directs nucleolar targeting and also couples snoRNA synthesis and localization. EMBO J. Jul. 1, 1998;17(13):3747-57.

Santini, S.M. et al., Type I interferon as a powerful adjuvant for monocyte-derived dendritic cell development and activity in vitro and in Hu-PBL-SCID mice. J Exp Med. May 15, 2000;191(10):1777-88.

Sanyal, S. et al., Effects of RNA on the developmental potentiality of the posterior primitive streak of the chick blastoderm. Proc Natl Acad Sci U S A. Apr. 1966;55(4):743-50.

Saponara, A.G. et al., The isolation from ribonucleic acid of substituted uridines containing alpha-aminobutyrate moieties derived from methionine. Biochem Biophys Acta. Apr. 27, 1974;349(1):61-77.

Satoh, M. et al., X-linked immunodeficient mice spotaneously produce lupus-related anti-RNA helicase A autoantibodies, but are resistant to pristane-induced lupus. Int Immunol. Sep. 2003;15(9):1117-24.

Sattharporn, S. et al., Dendritic cells (II): Role and therapeutic implications in cancer. J R Coll Surg Edinb. Jun. 2001;46(3):159-67.

Satz, M.L. et al., Mechanism of immune transfer by RNA extracts. Immune RNA induces the synthesis of idiotype-bearing antigen receptors in noncommitted cells. Mol Cell Biochem. Dec. 16, 1980;33(3):105-13.

Scheel, B. et al., Immunostimulating capacities of stabilized RNA molecules. Eur J Immunol. Feb. 2004;34(2):537-47.

Schirrmacher, V. et al., Intra-pinna anti-tumor vaccination with self-replicating infectious RNA or with DNA encoding a model tumor antigen and a cytokine. Gene Ther. Jul. 2000;7(13):1137-47

Schmidt, W.M. et al., CapSelect: a highly sensitive method for 5' CAP-dependent enrichment of full-length cDNA in PCR-mediated analysis of mRNAs. Nucleic Acids Res. Nov. 1, 1999;27(21):e31.

Schmitt, W.E. et al., In vitro induction of a bladder cancer-specific T-cell response by mRNA-transfected dendritic cells. J Cancer Res Clin Oncol. 2001;127(3):203-6.

Scholte, B.J. et al., Animal models of cystic fibrosis. J Cyst Fibros. Aug. 2004;3 Suppl 2:183-90.

Schott, J.W., et al., Viral and non-viral approaches for transient delivery of mRNA and proteins. Current Gene Ther. 2011; 11(5): 382-398.

Schuler, G. et al., Murine epidermal Langerhans cells mature into potent immunostimulatory dendritic cells in vitro. J Exp Med. Mar. 1, 1985;161(3):526-46.

Schuler-Thurner, B. et al., Mage-3 and influenza-matrix peptide-specific cytotoxic T cells are inducible in terminal stage HLA-A2.1+ melanoma patients by mature monocyte-derived dendritic cells. J Immunol. Sep. 15, 2000;165(6):3492-6.

Segura, J., et al., Monitoring gene therapy by extranal imaging of mRNA: Pilot study on murine erythropoietin. Ther Drug Monit. Oct. 2007; 29(5): 612-8.

Semple, S.C., et al., Efficient encapsulation of antisense oligonucleotides in lipid vesicles using ionizable aminolipids: formation of novel small multilamellar vesicle structures. Biochim Biophys Acta. Feb. 9, 2001; 1510(1-2): 152-166.

Semple, S.C., et al., Rational design of cationic lipids for siRNA delivery. Nat Biotechnol. Feb. 2010; 28(2): 172-176.

Serrate, S. et al., Transfer of cellular immunity in vivo with immune RNA in an allogeneic murine model. Clin Immunol Immunopathol. Jan. 1982;22(1):75-82.

Sharp, J.S. et al., Effect of translational signals on mRNA decay in Bacillus subtilis. J Bacteriol. Sep. 2003;185(18)5372-9.

Sharp, P.M. et al., DNA sequence evolution: the sounds of silence. Philos Trans R Soc Lond B Biol Sci. Sep. 29, 1995;349(1329):241-7.

Shea, R.G. et al., Synthesis, hybridization properties and antiviral activity of lipid-oligodeoxynucleotide conjugates. Nucleic Acids Res. Jul. 11, 1990;18(13):3777-83.

Shi, Y., et al., A combined chemical and genetic approach for the generation of induced pluripotent stem cells. Cell Stem Cell. Jun. 2008; 2: 525-528.

Shingo, T. et al., Erythropoietin regulates the in vitro and in vivo production of neuronal progenitors by mammalian forebrain neural stem cells. J Neurosci. Dec. 15, 2001;21(24):9733-43.

Shuman, S. et al., Purification and characterization of a GTP-pyrophosphate exchange activity from vaccinia virions. Association of the GTP-pyrophosphate exchange activity with vaccinia mRNA guanylyltransferase. RNA (guanine-7-) methyltransferase complex (capping enzyme). J Biol Chem. Dec. 10, 1980;256(23):1588-98.

Shuman, S., Capping enzyme in eukaryotic mRNA synthesis. Prog Nucleic Acid Res Mol Biol. 1995;50:101-29.

Shuman, S., Structure, mechanism, and evolutuion of the mRNA capping apparatus. Prog Nucleic Acid Res Mol Biol. 2001;66:1-40.

Siena, S. et al., Expansion of Immunostimulatory Dendritic Cells from Peripheral Blood of Patients with Cancer. Oncologist. 1997;2(1):65-69.

Simonaro, C.M. et al., Joint and bone disease in mucopolysaccharidoses VI and VII: identification of new therapeutic targets and biomarkers using animal models. Pediatr Res. May 2005;57(5 Pt 1):701-7. Epub Mar. 3, 2005.

Slapikoff, S. et al., Mechanism of ribonucleic acid polymerase action. Effect of nearest neighbors on competition between uridine triphosphate and uridine triphosphate analogs for incorporation into ribonucleic acid. Biochemistry. Dec. 1967; 6(12): 3654-3658.

Sleeman, J. et al., Dynamic interactions between splicing snRNPs, coiled bodies and nucleoli revealed using snRNP protein fusions to the green fluorescent protein. Exp Cell Res. Sep. 15, 1998;243(2):290-304.

Smith, C.M. et al., Sno storm in the nucleolus: new roles for myriad small RNPs. Cell. May 30, 1997;89(5):669-72.

Smith, J.P., et al., Drug retention and distribution after intratumoral chemotherapy with fluorouracil/epinephrine injectable gel in human pancreatic cancer xenografts. Cancer Chemother Pharmacol. 1999; 44: 267-274.

Smith, K.P. et al., Interactions of U2 gene loci and their nuclear transcripts with Cajal (coiled) bodies: evidence for PreU2 within Cajal bodies. Mol Biol Cell. Sep. 2000;11(9):2987-98.

Smith, W.S. et al., RNA modified uridines: VI: Conformations of 3-[3-(S)-Amino-3-Carboxypropyl]Uridine (acp3U) from tRNA and 1-Methyl-3-[3-(S)-Amino-3-Carboxypropyl]Pseudouridine (m1acp3?) from rRNA. Nucleosides and Nucleotides. 1992; 11(10):1683-94.

Smits, E., et al., RNA-based gene transfer for adult stem cells and T cells. Leukemia. 2004; 18: 1898-1902.

Smull, C.E., and Ludwig, E.H. Enhancement of the plaque-forming capacity of poliovirus ribonucleic acid with basic proteins. Journal of Bacteriology. 1962; 84(5): 1035-1040.

Sohn, R.L., et al., In-vivo particle mediated delivery of mRNA to mammalian tissues: ballistic and biological effects. Wound Rep and Regen. Jul.-Aug. 2001; 287-296.

Soll, D. Enzymatic modification of transfer RNA. Science. Jul. 23, 1971; 173(3994): 293-299.

Sontheimer, E.J. et al., The U5 and U6 small nuclear RNAs as active site components of the spliceosome. Science. Dec. 24, 1993;262(5142):1989-96.

Sousa, R. et al., T7 RNA polymerase. Prog Nucleic Acid Res Mol Biol. 2003;73:1-41.

Sousa, R., Use of T7 RNA polymerase and its mutants for incorporation of nucleoside analogs into RNA. Methods Enzymol. 2000;317:65-74.

Spooner, R.A. et al., DNA vaccination for cancer treatment. Gene Ther. May 1995;2(3):173-80.

Sproat, B.S., Chemistry and applications of oligonucleotide analogues. J Biotechnol. Jul. 31, 1995;41(2-3):221-38.

Staley, J.P. et al., Mechanical devices of the spliceosome: motors, clocks, springs, and things. Cell. Feb. 6, 1998;92(3):315-26.

Stanek, D. et al., Detection of snRNP assembly intermediates in Cajal bodies by fluorescence resonance energy transfer. J Cell Biol. Sep. 27, 2004;166(7):1015-25.

Steege, D.A., Emerging features of mRNA decay in bacteria. RNA. Aug. 2000;6(8):1079-90.

(56) References Cited

OTHER PUBLICATIONS

Steinman, R.M. et al., Dendritic cells: antigen presentation, accessory function and clinical relevance. Adv Exp Med Biol. 1993;329:1-9.
Steinman, R.M., The dendritic cell system and its role in immunogenicity. Annu Rev Immunol. 1991;9:271-96.
Stepinski, J. et al., Synthesis and properties of mRNAs containing the novel "anti-reverse" cap analogs 7-methyl(3'-O-methyl)GpppG and 7-methyl (3'-deoxy)GpppG. RNA. Oct. 2001;7(10):1486-95.
Malone, R.W. et al., Cationic liposome-mediated RNA transfection. Proc Natl Acad Sci U S A. Aug. 1989;86(16):6077-81.
Niu, M.C., Glucose-6-Phosphate: Re-examination of the RNA-Induced Activity in Mouse Ascites Tumor Cells. Science. 1965, 148:513-6.
Niu, M.C., Mode of Action of the Exogenous Ribonucleic Acid in Cell Function. Natl Cancer Inst. Monogr. 1964, 13:167-77.
Niu, M.C., et al., Poly(A)-attached RNA as activator in embryonic differentiation. Proc. Soc Exp Biol Med. Oct. 1974;147(1):318-22.
Niu, M.C., et al., Presence of liver-forming fraction in fish egg mRNAs detected by its ability to encode albumin syntehsis. Scientia Sinica. 1980, 23(4):510-6.
Niu, M.C., et al., Re-examination of the DNA-mediated transformation in goldfish. Scientia Sinica, 1983, 24(7):700-7.
Niu, M.C., The Development of Tubular heart in RNA-Treated Post-Nodal pieces of Chick Blastoderm. J Embryol. Exp. Morphol., 1973, 29:485-501.
Niu, M.C., The Effect of mRNA on Nuclear Activity in Developing Systems. 1980, 415-33.
Niu, M.C., The role of Exogenous Heart-RNA in Development of the Chick Embryo Cultivated In Vitro. J Embryol. Exp. Morphol., 1970, 64:57-64.
Niu, M.C., Thymus Ribonucleic Acid and Embryonic Differentiation. PNAS, 1958, 44:1264-1274.
Niu, M.C. et al., Transfer of information from mRNA to chromosomes by reverse transcription in early development of goldfish eggs. Cellular and Molecular Biology, 1989, 35(3):333-45.
Niu, M.C., VII. New Approaches to the Problem of Embryonic Induction. Cellular Mechanisms, Differentiation and Growth. 1956, 155-71.
Oberhauser, B. et al., Effective incorporation of 2'-O-methyl-oligoribonucleotides into liposomes and enhanced cell association through modification with thiocholesterol. Nucleic Acids Res. Feb. 11, 1992;20(3):533-8.
Occhiogrosso, G., et al., Prolonged convection-enhanced delivery into the rat brainstem. Neurosurgery. Feb. 2003; 52(2): 388-394.
Odens, M., Prolongation of the Life Span in Rats. Journal of the American Geriatrics Soc. Oct. 1973; 11(1):450-1.
O'Doherty, U. et al., Human blood contains two subsets of dendritic cells, one immunologically mature and the other immature. Immonology. Jul. 1994:82(3):487-93.
Ofengand, J. et al., The function of pseudouridylic acid in transfer ribonucleic acid: II. Inhibition of amino acyl transfer ribonucleic acid-ribosome complex formation by ribothymidylyl-pseudouridylyl-cytidylyl-guanosine 3'-phosphate. J Biol Chem. Nov. 25, 1969; 244(22): 6241-6253.
Ohashi, H. et al., Efficient protein selection based on ribosome display system with purified components. Biochem Biophys Res Commun. Jan. 5, 2007;352(1):270-6. Epub Nov. 13, 2006.
Ohmichi, T. et al., Efficient bacterial transcription of DNA nanocircle vectors with optimized single-stranded promoters. Ohmichi T, Maki A, Kool ET. Proc Natl Acad Sci U S A. Jan. 8, 2002;99(1):54-9. Epub Dec. 18, 2001.
Okumura, K. et al., Bax mRNA therapy using cationic liposomes for human malignant melanoma. J Gene Med. 2008; 10: 910-917.
Owen, M. et al., Stromal stem cells; marrow derived osteogenic precursors. CIBA Foundation Symposium, 1988, 136:42-60.
Ozawa, T. et al., Amplification and analysis of cDNA generated from a single cell by 5'-RACE: application to isolation of antibody heavy and light chain variable gene sequences from single B cells. Biotechniques. Apr. 2006;40(4):469-70.

Padilla, R. et al., A Y639F/H784A T7 RNA polymerase double mutant displays superior properties for synthesizing RNAs with non-canonical NTPs. Nucleic Acids Res. Dec. 15, 2002;30(24):e138.
Paglia, P. et al., Murine dendritic cells loaded in vitro with soluble protein prime cytotoxic T lymphocytes against tumor antigen in vivo. J Exp Med. Jan. 1, 1996;183(1):317-22.
Painter, H., et al., 494. Topical delivery of mRNA to the murine lung and nasal epithelium. Mol Ther. 2004; 9: S187.
Palu, G. et al., In pursuit of new developments for gene therapy of human diseases. J Biotechnol. Feb. 5, 1999:68(1):1-13.
Palucka, A.K. et al., Taming cancer by inducing immunity via dendritic cells. Immunol Rev. Dec. 2007;220:129-50.
Papapetrou, E., et al., Stoichiometric and temporal requirements of Oct4, Sox2, Klf4, and c-Myc expression for efficient human IPSC induction and differentiation. Natl. Acad. Sci USA. Aug. 2009; 106: 12759-12764.
Paradi, E. et al., Changes in the content of modified nucleotides in wheat rRNA during greening. Biologia Plantarum. Apr. 2003; 47(1):33-8.
Park, I., et al., Reprogramming of human somatic cells to pluripotency with defined factors. Nature. Jan. 2008; 451(10): 141-146.
Parker, R. et al., Recognition of the TACTAAC box during mRNA splicing in yeast involves base pairing to the U2-like snRNA. Cell. Apr. 24, 1987;49(2):229-39.
Pascolo, S. Vaccination with messenger RNA (mRNA). Handb Exp Pharmacol. 2008; 183:221-235.
Passini, M.A. et al., AAV vector-mediated correction of brain pathology in a mouse model of Niemann-Pick A disease. Mol Ther. May 2005;11(5):754-62.
Passos, G.A. et al., In vivo induction of immunological memory to human tumor extract with poly (A)-containing immune RNA. Cell Mol Biol. 1988;34(2):157-64.
Paul, S., et al., How to improve R&D productivity: the pharmaceutical industry's grand challenge. Nat Reviews Drug Discovery. Mar. 2010; 9: 203-214.
Pays, E., Characterization of double-stranded ribonucleic acid sequences present in the initial transcription products of rat liver chromatin. Biochem J. Aug. 1, 1977;165(2):235-45.
Pearson, W.R. et al., Improved tools for biological sequence comparison. Proc Natl Acad Sci U S A. Apr. 1988;85(8):2444-8.
Peculis, B. RNA processing: pocket guides to ribosomal RNA. Curr Biol. Aug. 1, 1997;7(8):R480-2.
Peng, Z.H. et al., Synthesis and application of a chain-terminating dinucleotide mRNA cap analog. Org Lett. Jan. 24, 2002;4(2):161-4.
Peoples, G.E. et al., Breast and ovarian cancer-specific cytotoxic T lymphocytes recognize the same HER2/neu-derived peptide. Proc Natl Acad Sci U S A. Jan. 17, 1995;92(2):432-6.
Perche, F., et al., Enhancement of dedritic cells transfection in vivo and of vaccination against B16F10 melanoma with mannosylated histidylated lipopolyplexes loaded with tumor antigen messenger RNA. Nanomed: Nanotech, Bio, and Med. Aug. 2011; 7(4): 445-453.
Pesole, G. et al., Structural and functional features of eukaryotic mRNA untranslated regions. Gene. Oct. 3, 2001;276(1-2):73-81.
Pesole, G. et al., UTRdb and UTRsite: specialized databases of sequences and functional elements of 5' and 3' untranslated regions of eukaryotic mRNAs. Update 2002. Nucleic Acids Res. Jan. 1, 2002;30(1):335-40.
Petit, I. et al. G-CSF induces stem cell mobilization by decresing bone marrow SDF-I and up-regulating CXCR4, Nature Immunology, Jul. 2002; 3(7): 687-694.
Phillips, J. et al., Antisense RNA Amplification: A Liner Amplification Method for Analyzing the mRNA Population from single Living Cells. Methods. Dec. 1996;10(3):283-8.
Phizicky, E.M. et al., [31] Biochemical genomics approach to map activities to genes. Methods Enzymol. 2002;350:546-59.
Pollard, C., et al., Type I IFN counteracts the induction of antigen-specific immune responses by lipid-based delivery of mRNA vaccines. Mol Ther. Jan. 2013: 21(1): 251-259.
Ponsaerts, P. et al., Cancer immunotherapy using RNA-located dendritic cells. Clin Exp Immunol. Dec. 2003;134(3):378-84.

(56) References Cited

OTHER PUBLICATIONS

Ponsaerts, P. et al., Messenger RNA electroporation is highly efficient in mouse embryonic stem cells: successful FLPe- and Cre-mediated recombination. Gene Ther. Nov. 2004;11(21):1606-10.

Ponsaerts, P., et al., Highly efficient mRNA-based gene transfer in feeder-free cultured H9 human embryonic stem cells. Cloning and Stem Cells. 2004; 6(3): 211-216.

Agadjanyan, M., Prototype Alzheimer's Disease Vaccine Using the Immunodominany B Cell Type from β—Amloid and Promiscuous T Cell Epitope Pan HLA DR-Binding Peptide, J Immunol, 2005, vol. 174, no number, pp. 1580-1586.

Cribbs, David H., Adjuvant-dependent Modulation of Th1 and Th2 Responses to Immunization with β-amyloid, International Immunology, vol. 15, No. 4, pp. 505-514.

Davtyan, H. et al., Immunogenicity, Efficacy, Safety, and Mechanism of Action of Epitope Vaccine (Lu AF20513) for Alzheimer's Disease: Prelude to a Clinical Trial, The Journal of Neuroscience, Mar. 2013, vol. 33, No. 11, pp. 4923-4934.

Zwick, M. et al., Identification and Characterization of a Peptide That Specifically Binds the Human, Broadly Neutralizing Anti-Human Immunodeficiency Virus Type 1 Antibody b12, Journal of Virology, Jul. 2001, vol. 75, No. 14, pp. 6692-6699.

Zwick, M. et al., Molecular Features of the Broadly Neutralizing Immunoglobulin G1, b12 Required for Recognition of Human Immunodeficiency Virus Type 1 gp120, Journal of Virology, 2003, vol. 77, No. 10, pp. 5863-5876.

Wilkinson, R. et al., Structure of the Fab Fragment of F105, a Broadly Reactive Anti-Human Immunodeficiency Virus (HIV) Antibody that Recognizes the CD4 Binding Site of HIV type 1 gp120, Journal of Virology, 2005, vol. 79, No. 20, pp. 13060-13069.

Julien, Jean-Philippe et al., Broadly Neutralizing Antibody PGT121 Allosterically Modulates CD4 Binding via Recognition of the HIV-1 gp120 V3 Base and Multiple Surrounding Glycans, PLOS Pathogens, 2013, vol. 9, Issue 5, pp. 1-15.

Laursen, N. et al., Broadly Neutralizing Antibodies Against Influenza Viruses, Antiviral Research, 2013, vol. 98, no number, pp. 476-483.

Barouch, Dan et al., Therapeutic Efficacy of Potent Neutralizing HIV-1-specific monoclonal Antibodies in SHIV-infected Rehesus Monkeys, Nature, 2013, vol. 503, No. 7475, pp. 224-228.

Shingai, M. et al., Antibody-mediated Immunotherapy of Macaques Chronically Infected with SHIV Suppresses Viraemia, Nature, 2013, vol. 503, No. 7475, pp. 277-280.

Balaza, Alejandro et al., Vectored Immunoprophylaxis Protects Humanized Mice from Mucosal HIV Transmission, Nature Medicine, 2014, vol. 3, pp. 296-300.

Burton, Dennis et al., A Large Array of Human Monoclonal Antibodies to Type 1 Human Immunodefiency Virus From Combinatorial Libraries of Asymptomatic Seropositive Individuals, Proc. Natl Acad., USA,1991, vol. 88, No Number, pp. 10134-10137.

Burton, Dennis et al., Efficient Neutralization of Primary Isolates of HIV-1 by a Recombinant Human Monoclonal Antibody, Science, 1994, vol. 266, No Number, pp. 1024-1027.

Scheid, Johannes et al., Sequence and Structural Convergence of Broad and Potent HIV Antibodies That Mimic CD4 Binding, Science , 2011, vol. 333, No Number, 1633-1637.

Ledford, H., Supercharged Antibodies Fight HIV-Related Virus in Monkeys, Nature, 2013, No Volume, pp. 1-2.

Delehanty, James B., Peptides for Specific Intracellular Delivery and Targeting of Nanoparticles: Implications for Developing Nanoparticle-Mediated Drug Delivery, Future Science, Therapeutic Delivery, 2010, vol. 1, No. 3, pp. 411-433.

Dharap, S.S., et al., Tumor-specific Targeting of an Anticancer Drug Delivery System by LHRH Peptide, PNAS, 2005, vol. 102, No. 36, pp. 12962-12967.

Du, L. et al., Arginine-rich cell-penetrating peptide dramatically enhances AMO-mediated ATM Aberrant Splicing Correction and Enables Delivery to Brain and Cerebellum, Human Molecular Genetics, 2011, vol. 20, No. 16, pp. 3151-3160.

Ezzat, Kariem et al. PepFect 14, a Novel Cell-penetrating Peptide for Oligonucleotide Deliver in Solution and As Solid Formulation, Nucleic Acids Research, 2011, vol. 39, No. 12, pp. 5284-5298.

Fang, Shun-lung et al., A Novel Cell-Penetrating Peptide Derived from Human Eosinophil Cationic Protein, PLOS One, 2013, vol. 8, Issue 3, pp. 1-13.

Giblin, M. et al., Selective Targeting of E. coli Heat-stable Enterotoxin Analogs to Human Colon Cancer Cells, Anticancer Research, 2006,vol. 26, No number, pp. 3243-3252.

Kelly, Kimberley et al. , Isolation of a Colon Tumor Specific Binding Peptide Using Phage Display Selection, Neoplasia, 2003, vol. 5, No. 5, pp. 437-444.

Knowles, Lynn et al., CLT1 Targets Angiogenic Endothelium through CLIC1 and Fibronectin, Angiogenesis, 2012, vol. 15, No. 1, pp. 115-129.

Laakkonen, Pirjo et al., Homing Peptides as Targeted Delivery Vehicles, Interactive Biology , 2010, vol. 2, No number, pp. 326-337.

Li, Zhi Jie, et al. Peptides as Targeting Probes Against Tumor Vasculature for Diagnosis and Drug Delivery, Journal of Translational Medicine, 2012, vol. 10 , Supp 1, No. s1, pp. 1-9.

Lin, Jieru et al., Bacterial Heat-Stable Enterotoxins: Translation of Pathogenic Peptides into Novel Targeted Diagnostics and Therapeutics, Toxins, 2010, vol. 2, No number, pp. 2028-2054.

Lo, Albert et al., Hepatocellular Carcinoma Cell-Specific Peptide Ligand for Targeted Drug Delivery, Molecular Cancer Therapeutics, 2008, vol. 7 , No. 3, pp. 579-589.

Lu, Ruei-Min et al., Targeted Drug Delivery Systems Mediated by a Novel Peptide in Breast Cancer Therapy and Imaging, PLOS One, 2013, vol. 8, Issue 6, pp. 1-13.

Pangburn, Todd et al., Peptide- and Aptamer-Functionalized Nanovectors for Targeted Delivery of Therapeutics, Journal of Biomedical Engineering, 2009, vol. 131, No number, pp. 1-20.

Phelan, Anne et al., Intercellular Delivery of Functional p53 by the Herpesvirus Protein VP22, Nature Biotechnology , 1998, vol. 16, pp. 440-443.

Laakkonen, Pirjo et al., Homing Peptides as Targeted Delivery Vehicles, Integrative Biology, 2010, vol. 2, no number, pp. 326-337.

Regberg, Jakob et al., Applications of Cell-Penetrating Peptides for Tumor Targeting and Future Cancer Therapies, Pharmaceuticals, 2012, vol. 5, No number, pp. 991-1007.

Suchanek, Gerda et al., Amino Acid Sequence of Honeybee Prepromelittin Synthesized in Vitro, Proc. Natl. Acad. Sci. USA,1978, vol. 75, No. 2, pp. 701-704.

Torchilin, Vladimir et al., Multifunctional and Stimuli-Sensitive Pharmaceutical Nanocarriers, Eur J. Pharm Biopharm, 2009, vol. 71, No. 3, pp. 431-444.

Yang, Xiaoming, et al., Effect of CD44 Binding Peptide Conjugated to an Engineered Inert Matrix on Maintenance of Breast Cancer Stem Cells and Tumorsphere Formation, PLOS One, 2013, vol. 8, Issue 3, pp. 1-15.

Zou, Li-li et al., Cell-Penetrating Peptide-Mediated Therapeutic Molecule Delivery Into the Central Nervous System, Current Neuropharmacology, 2013, vol. 11, No. 2, pp. 197-208.

Baars, A. et al., A Phase II Study of Active Specific Immunotherapy and 5-FU/Leucovorin as Adjuvant Therapy for Stage III Colon Carcinoma, British Journal of Cancer, 2002, vol. 86, No. 8, pp. 1230-1234.

Badawi, Ahmed, et al. , Immune Modulating Peptide for the Treatment and Suppression of Multiple Sclerosis, Clin Immunol, 2012, vol. 144, No. 2, pp. 127-138.

Bandala-Sanchez, Esther et al., T cell Regulation Mediated by Interaction of Soluble CD52 with the Inhibitory Receptor Siglec-10, Nature Immunology, 2013, vol. 14, No. 7, pp. 741-751.

Lu, Changming et al., miR-221 and miR-155 Regulate Human Dendritic Cell Development Apoptosis, and IL-12 Production Through Targeting of p27kip1, KPC1 and SOCS-1, Blood, 2011, vol. 117, No. 16, pp. 4293-4303.

Chang, C et al., Tolerization of Dendritic Cells by Ts cells: The Crucial Role of Inhibitory Receptors ILT3 and ILT4, Nature Immunology, 2002, vol. 3, No. 3, pp. 237-243.

(56) References Cited

OTHER PUBLICATIONS

Cheng, Guotan et al., T Cell Tolerance and the Multi-Functional Role of IL-2R Signalling in T Regulatory Cells, Immunol Rev., 2011, vol. 241, No. 1, pp. 63-76.
Cools, Nathalie, et al., Balancing Between Immunity and Tolerance: an Interplay Between Dendritic Cells, Regulatory T Cells, and Effector T Cells, Journal of Leukocyte Biology, 2007, vol. 82, pp. 1365-1374.
Cousens, Leslie et al., Tregitope Update: Mechanism of Action Parallels IVIg, Autoimmunity Reviews, 2012, No Volume, pp. 1-8.
Cousens, L. et al., In Vitro and In Vitro Studies of IgC-derived Treg Epitopes (Tregitopes): A Promising New Tool for Tolerance Induction and Treatment of Autoimmunity, J. Clin. Immunol, 2013, vol. 33, Supp 1, pp. 43-49.
Cousens, Leslie et al., Application of IgC-Derived Natural Treg Epitopes (IgG Tregitopes) to Antigen-Specific Tolerance Induction in a Murine Model of Type 1 Diabetes, Journal of Diabetes, vol. 2013, Article ID 621693, pp. 1-17.
Danke, Nancy et al., Comparative Study of GAD65-specific CD4+ T cells in healthy and Type 1 Diabetic Subjects, Journal of AutoImmunity, 2005, vol. 25, No Number, 303-311.
DeGroot, Anne S. et al., Activation of Natural Regulatory T cells by IgG F-derived peptide "Tregitopes", 2008, vol. 112, No. 8, pp. 3303-3311.
DiCaro, Valentina, et al., In Vivo Delivery of Nucleic Acid-Formulated Microparticles as a Potential Tolerogenic Vaccine for Type 1 Diabetes, 2012, vol. 9, No. 4, pp. 348-356.
EMEA, Committee for Medicinal Products for Human Use, European Medicines Agency, 2008, No Vol. pp. 1-13.
European Search Report in Application No. 12831509.0, dated Apr. 8, 2015.
Kariko, K. et al., Incorporation of pseudouridine into mRNA yields superior nonimmunogenic vector with increased translational capacity and biological stability. Molecular Therapy, Nature Publishing Group, GB, vol. 16, No. 11, Nov. 1, 2008, pp. 1833-1840.
Kariko, K. et al, Generating the optimal mRNA for therapy: HPLC purification eliminates immune activation and improves translation of nucleoside-modified, protien-encoding mRNA, Nucleic Acids Research, Oxford University Press, GB, vol. 39, No. 21, Sep. 2, 2011, pp. e142-1.
Kariko, K., et al., Impacts of nucleoside modification on RNA-mediated activation of toll-like receptors, Jan. 1, 2008, Nucleic Acids in Innate Immunity, CRC Press-Taylor & Francis Group, 6000 Broken Sound Parkway NW, STE 300, Boca Raton, FL 33487-2742 USA, pp. 171-188.
Conry, R.M. et al., Characterization of a messenger RNA polynucleotide vaccine vector. Cancer Res. Apr. 1, 1995;55(7):1397-400.
Conry, R.M. et al., Immune response to a carcionoembryonic antigen polynucleotide vaccine. Cancer Res. Mar. 1, 1994;54(5):1164-8.
Conry, R.M. et al., A carcinoembryonic antigen polynucleotide vaccine has in viro antitumor activity. Gene Ther. Jan. 1995;2(1):59-65.
Copreni, E. et al., Lentivirus-mediated gene transfer to the respiratory epithelium: a promising approach to gene therepy of cystic fibrosis. Gene Ther. Oct. 2004;11 Suppl 1:S67-75.
Cortes, J.J. et al., Mutations in the conserved loop of human U5 snRNA generate use of novel cryptic 5' splice sites in vivo. EMBO J. Dec. 15, 1993;12(13):5181-9.
Coughlin, C.M. et al., Targeting adult and pediatric cancers via cell-based vaccines and the prospect of activated B lymphocytes as a novel modality. Cancer Biol Ther. Sep.-Oct. 2003;2(5):466-70.
Cox, G.J. et al., Bovine herpesvirus 1: immune responses in mice and cattle injected with plasmid DNA. J Virol. Sep. 1993;67(9):5664-7.
Craig, J.M. et al., The distribution of CpG islands in mammalian chromosomes. Nat Genet. Jul. 1994;7(3):376-82.

Cramer, P. et al., Functional association between promoter structure and transcript alternative splicing. Proc Natl Acad Sci U S A. Oct. 14, 1997;94(21):11456-60.
Cree, B. et al., Tolerability and effects of rituxamab (anti CD20 antibody) in neuromyelitis optica (NMO) and rapidly worsening multiple sclerosis (MS). Neurology. 2004; 62(S5):A492.
Cuburu, N. et al., Intravaginal immunization with HPV vectors induces tissue-resident CD8+ T cell responses. J Clin Invest. Dec. 3, 2012; 122(12): 4606-4620.
Culver, K.W. et al., Gene Therapy. A Handbook for Physicians. Mary Ann Lieber, Inc. New York. 1994; 63-77.
Cunningham, S. et al., AAV2/8-mediated correction of OTC deficiency is robust in adult but not neonatal Spf$^\wedge$ ash Mice. Mol Ther. Aug. 2009; 17(8): 1340-1346.
Daguer, J.P. et al., Increasing the stability of sacB transcript improves levansucrase production in Bacilius subtilis. Lett Appl Microbiol. 2005;41(2):221-6.
Dai, M.S. et al., Introduction of human erythropoietin receptor complementary DNA by retrovirus-mediated gene transfer into murine embryonic stem cells enhances erythropoiesis in developing embryoid bodieds. Biol Blood Marrow Transplant. 2000;6(4):395-407.
Davidson, E.H., An Analysis of Niu Menchang's Research on Transformation by RNA. Biotechnology in China, 1989, 92-102.
Davis, H.L. et al., DNA-based immunization induces continuous secretion of hepatitis B surface antigen and high levels of circulating antibody. Hum Mol Genet. Nov. 1993;2(11):1847-51.
De Carvalho, S. et al., Biologic properties of human leukemic and tumoral RNA. IV. Leukemia and neoplasms induced in mice with human leukemic RNA carried in tissue culture. J Lab Clin Med. May 1960;55:706-14.
De Carvalho, S. et al., Comparative effects of liver and tumour ribonucleic acids on the normal liver and the Novikoff hepatoma cells of the rat. Nature. Mar. 11, 1961;189:815-7.
De Carvalho, S. et al., Differences in information content of ribonucleic acids from malignant tissues and homologous organs as expressed by their biological activities. Exp Mol Pathol. Apr. 1962;1:96-103.
De Carvalho, S., Angiokines, angiogenesis and angiolymphoproliferative syndromes (ALPS). Angiology. Apr. 1983;34(4):231-43.
De Carvalho, S., Biologic properties of human leukemic and tumoral RNA, III. The effect of different media on the cytopathogenicitv in tissue culture. J Lab Clin Med. May 1960;55:694-705.
De Carvalho, S., Cancer 1974: an analytical vademecum of oncologic relevance. Oncology. 1973;28(4):289-98.
De Carvalho, S., Effect of RNA from normal human bone marrow on leukaemic marrow in vivo. Nature. Mar. 16, 1963;197:1077-80.
De Carvalho, S., Epigenetic transformation by RNA from human neoplastic cells. Oncology. 1973;27(1):3-29.
De Carvalho, S., In vitro angiogenic activity of RNA from leukemic lymphocytes. Angiology. Jul. 1978;29(7):497-505.
De Carvalho, S., Natural history of cogenital leukemia. An experiment of nature revealing unexplored features of fetal-material isoimmunity, longest recorded survival following use of leukemostatic maternal isoantibody. Oncology. 1973;27(1):52-63.
De Lucca, F.L., et al., Effect of the calcium phosphate-mediated RNA uptake on the transfer of cellular immunity of a synthetic peptide of HIV-1 to human lymphocytes by exogenous RNA. Mol Cell Biochem. Dec. 2001;228(1-2):9-14.
Delafontaine, P. et al., Regulation of vascular smooth muscle cell insulin-like growth factor I receptors by phosphorothioate oligonucleotides. Effects on cell growth and evidence that sense targeting at the ATG site increases receptor expression. J Biol Chem. Jun. 16, 1995;270(24):14383-8.
Deres, K. et al., In vivo priming of virus-specific cytotoxic T lymphocytes with synthetic lipopeptide vaccine. Nature. Nov. 30, 1989;342(6249):561-4.
Deshayes, S. et al., Cell-penetrating peptides: tools for intracellular delivery of therapeutics. Cell Mol Life Sci. Aug. 2005;62(16):1839-49.

(56) References Cited

OTHER PUBLICATIONS

Desrosiers, R. et al., Identification of methylated nucleosides in messenger RNA from Novikoff hepatoma cells. Proc Natl Acad Sci U S A. Oct. 1974;71(10):3971-5.
Diebold, S.S. et al., Innate antiviral responses by means of TLR7-mediated recognition of single-stranded RNA. Science. Mar. 5, 2004;303(5663):1529-31. Epub Feb. 19, 2004.
Dimari, J.F. et al., Initiation of mRNA decay in Bacillus subtilis. Mol Bicrobiol. Mar. 1993;7(5):705-17.
Ding, Z., et al., State-of-the-art 2003 on PKU gene therapy. Mol Genet Metab. Jan. 2004;81(1):3-8.
Dingman, W. et al., Molecular theories of memory. Science. Apr. 3, 1964;144(3614):26-9.
Disbrow, G.L. et al., Codon optimization of the HPV-16 E5 gene enhances protein expression. Virology. Jun 20, 2003;311(1):105-14.
Dong, Y. et al., Poly(d.1-lactide-co-glycolide)/montmorillonite nanoparticles for oral delivery of anticancer drugs. Biomaterials. Oct. 2005;26(30):6068-76.
Donnelly, J. et al., Technical and regulatory hurdles for DNA vaccines. Int J Parasitol. May 2003;33(5-6):457-67.
Dubes, G.R. and Klingler, E.A. Jr. Facilitation of infection of monkey cells with poliovirus "ribonucleic acid." Science. Jan. 1961; 133(3446): 99-100.
Dunham, S.P. et al., The application of nucleic acid vaccines in veterinary medicine. Res Vet Sci. Aug. 2002;73(1):9-16.
Dunn, J.J. et al., Different template specificities of phage T3 and T7 RNA polymerases. Nat New Biol. Mar. 17, 1971;230(11):94-6.
Duret, L. et al., Expression pattern and surprisingly, gene length shape codon usage in Caenorhabditis, *Drosophila*, and Arabidopsis. Proc Natl Acad Sci U S A. Apr. 13, 1999;96(8):4482-7.
Duret, L., Evolution of synonymous codon usage in metazonas. Curr Opin Genet Dev. Dec. 2002;12(6):640-9.
Earl, R.A., et al., A chemical synthesis of the nucleoside 1-Methylpseudouridine. A facile chemical synthesis of 1-methylpseudouridine has been accomplished by direct methylation of pseudouridine. J Heterocyclic Chem. Jun. 1977;14:699-700.
Easton, L.E. et al., Rapid, nondenaturing RNA purification using weak anion-exchange fast performance liquid chromatography. RNA. Mar. 2010;16(3):647-53. Epub Jan. 25, 2010.
Eberwine, J. et al., Analysis of gene expression in single live neurons. Proc Natl Acad Sci U S A. Apr. 1, 1992;89(7):3010-4.
Edelstein, M. L. et al., Gene therapy clinical trials worldwide 1989-2004—an overview. J Gene Med. Jun. 2004;6(6):597-602.
Edery, I. et al., An efficient strategy to isolate full-length cDNAs based on an mRNA cap retention procedure (CAPture). Mol Cell Biol. 1995; 15(6): 3363-3371.
Edmonds, M., Polyadenylate polymerases. Methods Enzymol. 1990:181:161-70.
Biocca, S., et al., Intracellular expression of anti-p21^ras single chain Fv fragments inhibits meiotic maturation of xenopus oocytes. Biochem Biophys Res Comm. Dec. 15, 1993; 197(2): 422-427.
Bird, A.P. et al., CpG-rich islands and the function of DNA methylation. Nature. May 15-21, 1986;321(6067):209-13.
Black, D.D. et al., Similarity of the transfer factors in Novikoff ascites tumor and other amino acid-incorporating systems. Cancer Res. May 1970;30(5):1281-6.
Bloch, G. et al., Sequence-dependence of the conformational changes induced by the 5-methyl cytosine in synthetic RNA oligomers. FEBS Lett. Jul. 27, 1987;219(2):464-8.
Boczkowski, D. et al., Dendritic cells pulsed with RNA are potent antigen-presenting cells in vitro and in vivo. J Exp Med. Aug. 1, 1996;184(2):465-72.
Boczkowski, D. et al., Induction of tumor immunity and cytotoxic T lymphocyte responses using dendritic cells transfected with messenger RNA amplified from tumor cells. Cancer Res. Feb. 15, 2000;60(4):1028-34.
Bonehill, A., et al., Single-step antigen loading and activation of dendritic cells by mRNA electroporation for the purpose of therapeutic vaccination in melanoma patients. Clin Cancer Res. May 2009; 15(10): 3366-3375.
Boon, T. et al., Genes coding for tumor rejection antigens: perspectives for specific immunotherapy. Important Adv Oncol. 1994:53-69.
Bose, S. et al., Role of nucleolin in human parainfluenza virus type 3 infection of human lung epithelial cells. J Virol. Aug. 2004;78(15):8146-58.
Bouxsein, N.F., et al., Structure and gene silencing activities of monovalent and pentavalent cationic lipid vectors complexed with siRNA†. Biochem. 2007; 46(16): 4785-4792.
Brandt, B. et al., Detection of the metastatic potential of blood-borne and immunomagnetically enriched epithelial cells by quantitative erbB-2 RT-PCR. Clin Exp Metastasis. Sep. 1996;14(4):399-408.
Brieba, L.G., et al., Role of T7 RNA polymerase His784 in start site selection and initial transcription. Biochem. 2002; 41: 5144-5149.
Brossart, P. et al., Her-2/neu-derived peptides are tumor-associated antigens expressed by human renal cell and colon carcinoma lines and are recognized by in vitro induced specific cytotoxic T lymphocytes. Cancer Res. Feb. 15, 1998;58(4):732-6.
Brossart, P. et al., Identification of HLA-A2-restricted T-cell epitopes derived from the MUC1 tumor antigen for broadly applicable vaccine therapies. Blood. Jun. 15, 1999;93(12):4309-17.
Brossart, P. et al., Induction of cytotoxic T-lymphocyte responses in vivo after vaccinations with peptide-pulsed dendritic cells. Blood. Nov. 1, 2000;96(9):3102-8.
Brossart, P. et al., Virus-mediated delivery of antigenic epitopes into dendritic cells as a means to induce CTL. J Immunol. Apr. 1, 1997;158(7):3270-6.
Buccoliero, R. et al., Elevation of lung surfactant phosphatidylcholine in mouse models of Sandhoff and of Niemann-Pick A disease. J Inherit Metab Dis. 2004;27(5):641-8.
Burke, B. et al., Microinjection of mRNA coding for an anti-Golgi antibody inhibits intracellular transport of a viral membrane protein. Cell. Apr. 1984;36(4):847-56.
Burks, E.A. et al, In vitro scanning saturation mutagenesis of an antibody binding pocket. Proc Natl Acad Sci U S A. Jan. 21, 1997;94(2):412-7.
Butler, E.T. et al., Bacteriophage SP6-specific RNA polymerase. I. Isolation and characterization of the enzyme. J Biol Chem. May 25, 1982;257(10):5772-8.
Cannon, G. et al., RNA based vaccines. DNA Cell Biol. Dec. 2002;21(12):953-61.
Capoccia, B.J., et al., G-CSF and AMD3100 mobilize monocytes into the blood that stimulate angiogenesis in vivo through a paracrine mechanism. Blood Oct. 1, 2006; 108(7): 2438-2445.
Caput, D. et al., Identification of a common nucleotide sequence in the 3'-untranslated region of mRNA molecules specifying inflammatory mediators. Proc Natl Acad Sci U S A. Mar. 1986;83(6):1670-4.
Caron, H. et al., The human transcriptome map: clustering of highly expressed genes in chromosomal domains. Science. Feb. 16, 2001;291(5507):1289-92.
Carralot, J.P. et al., Polarization of immunity induced by direct injection of naked sequence-stabilized mRNA vaccines. Cell Mol Life Sci. Sep. 2004;61(18):2418-24.
Carralot, J.P. et al., Production and characterization of amplified tumor-derived cRNA libraries to be used as vaccines against metastatic melanomas. Genet Vaccines Ther. Aug. 22, 2005;3:6.
Caudy, A.A. et al., Fragile X-related protein and VIG associate with the RNA interference machinery. Genes Dev. Oct. 1, 2002;16(19):2491-6.
Cavaille, J. et al., Identification of brain-specific and imprinted small nucleolar RNA genes exhibiting an unusual genomic organization. Proc Natl Acad Sci U S A. Dec. 19, 2000;97(26):14311-6.
Cavaille, J. et al., Targeted ribose methylation of RNA in vivo directed by tailored antisense RNA guides. Nature. Nov. 24, 1996;383(6602):732-5.

(56) References Cited

OTHER PUBLICATIONS

Celluzzi, C.M. et al., Peptide-pulsed dendritic cells induce antigen-specific CTL-mediated protective tumor immunity. J Exp Med. Jan. 1, 1996;183(1):283-7.

Chan, E. et al., Live cell imaging distinguishes bona fide human iPS cells from partially reprogrammed cells. Nat Biotech. Nov. 2009: 27(11): 1033-1037.

Chappell, S.A. et al., Ribosomal tethering and clustering as mechanisms for translation initiation. Proc Natl Acad Sci U S A. Nov. 28, 2006;103(48):18077-82. Epub Nov. 16, 2006.

Charette, M. et al., Pseudouridine in RNA: what, where, how, and why. IUBMB Life. May 2000;49(5):341-51.

Chen, D., et al., Rapid discovery of potent siRNA-containing lipid nanoparticles enabled by controlled microfluidic formulation. J Am Chem Soc. 2012; 134: 6948-6951.

Chen, H., et al., TGF-beta 1 attenuates myocardial ischemia-reperfusion injury via inhibition of upregulation of MMP-1. Am J Physiol Heart Circ Physiol. May 2003; 284(5): H1612-7.

Chen, Z. et al., Enhanced protection against a lethal influenza virus challenge by immunization with both hemagglutinin- and neuraminidase-expressing DNAs. Vaccine. Feb. 26, 1999;17(7-8):653-9.

Cheng, C., et al., Multifunctional triblock copolymers for intracellular messenger RNA delivery. Biomaterials. Oct. 2012; 33(28): 6868-6876.

Cheng, W.F. et al., Enhancement of Sindbis virus self-replicating RNA vaccine potency by linkage of herpes simplex virus type 1 VP22 protein to antigen. J Virol. Mar. 2001;75(5):2368-76.

Cheng, W.F. et al., Enhancement of Sindbis virus self-replicating RNA vaccine potency by linkage of *Mycobacterium tuberculosis* heat shock protein 70 gene to an antigen gene. J Immunol. May 15, 2001;166(10):6218-26.

Cho, J.H. et al., Enhanced cellular immunity to hepatitis C virus nonstructural proteins by codelivery of granulocyte macrophage-colony stimulating factor gene in intramuscular DNA immunization. Vaccine. Mar. 5, 1999;17(9-10):1136-44.

Chui, H.M. et al., Synthesis of helix 69 of *Escherichia coli* 23S rRNA containing its natural modified nucleosides, m(3) Psi and Psi. J Org Chem. Dec. 13, 2002;67(25):8847-54.

Clawson, G.A. et al., Increased amounts of double-stranded RNA in the cytoplasm of rat liver following treatment with carcinogens. Cancer Res. Aug. 1982;42(8):3228-31.

Cohen, P.J. et al., Murine epidermal Langerhans cells and splenic dendritic cells present tumor-associated antigens to primed T cells. Eur J Immunol. Feb. 1994;24(2):315-9.

Collas, P. et al., Epigenetic reprogramming of nuclei using cell extracts. Stem Cell Rev. 2006;2(4):309-17.

Binder, R. et al., Evidence that the pathway of transferrin receptor mRNA degradation involves an endonucleolytic cleavage within the 3' UTR and does not involve poly(A) tail shortening. EMBO J. Apr. 15, 1994;13(8):1969-80.

Collas, P., Dedifferentiation of cells: new approaches. Cytotherapy. 2007;9(3):236-44.

Colter, J.S., et al., Infectivity of ribonucleic acid isolated from virus-infected tissues. Virology. 1957; 4(3): 522-532.

Colot, V. et al., Eukaryotic DNA methylation as an evolutionary device. Bioessays. May 1999;21(5):402-11.

Colter, J.S., et al., Infectivity of ribonucleic acid from Ehrlich Ascites tumour cells infected with Mengo Encephalitis. Nature. Apr. 1957; 179(4565): 859-860.

Condon, C. et al., DNA-based immunization by in vivo transfection of dendritic cells. Nat Med. Oct. 1996;2(10):1122-8.

International Search Report from International Application No. PCT/US2012/054561 dated Feb. 26, 2013.

Barlow, et al., The Human Cathelicidin LL-37 Preferentially Promotes Apoptosis of Infected Airway Epithelium. Am J Respir Cell Mol Biol. Dec. 2010, vol. 43, No. 6, pp. 692-702, entire document.

Evel-Kabler, Kevin et al., SOCS1 Restricts Dendritic Cells' Ability to Break Self Tolerance and Induce Antitumor Immunity by Regulating IL-12 Production and Signaling, The Journal of Clinical Investigation, 2006, vol. 116, No. 1, pp. 90-100.

Finn, Jonathan et al., Eradication of Neutralizing Antibodies to Factor VIII in Canine Hemophila A After liver Gene Therapy, Blood, 2010, vol. 116, No. 26, pp. 5842-5848.

Han, Shuhong et al., Novel Autoantigens in Type 1 Diabetes, Am J Transl Res, 2013, vol. 5, No. 4, pp. 379-392.

High, Katherine, et al. The Gene Therapy Journey for Hemophilia: Are We There Yet?, Blood, 2012, vol. 120, No. 23, pp. 4482-4487.

Hoffman, Brad et al., Nonredundany Roles of IL-10 and TGF-β in Supression of Immune Responses tp Hepatic AAV-Factor IX Gene Transfer, The American Society of Gene and Cell Therapy, 2011, vol. 19, No. 7, pp. 1263-1272.

Hopkins, Benjamin et al., A Secreted PTEN Phosphatase That Enters Cells to Alter Signaling and Survival, Science, 2013,vol. 341, No. 399, pp. 399-341.

Takahashi, R. et al., SOCS1 is Essential for Regulatory T Cell Functions by Preventing Loss of Foxp3 Expression as Well AsIFN-y and IL-17A Production, The Journal of Experimental Medicine, 2011, vol. 208, No. 10, pp. 2055-2067.

Piganis, R. et al., Suppressor of Cyokine Signaling (SOCS) 1 Inhibits Type 1 Interferon (IFN) Signaling via the Interferon a Receptor (IFNAR1)-associated Tyrosine Kinase Tyk2, The Journal of Biological Chemistry, vol. 286, No. 39, pp. 33811-33818.

Jacobsen, Lars et al., Allergen-specific Immunotherapy Provide Immediate, Long-Term and Preventive Clinical Effects in Children and Adults: The Effects of Immunotherapy Can be Categorised by Level of Benefit—the centenary of Allergen Specific Subcutaneous Immunotherapy, Clinical and Translational Allergen, 2012, vol. 2, No. 8, pp. 1-11.

Kinjyo, Ichiko et al., SOCS1/JAB is A Negative Regulator of LPD-Induced Macrophage Activation, Immunity, 2002, vol. 17, No number, pp. 583-591.

LoDuca, Paul et al., Hepatic Gene Transfer as a Means of Tolerance Induction to Transgene Products, Curr Gene Ther. 2009, vol. 9, No. 2, pp. 104-114.

Lu, Li-Fan et al., Foxp3-Dependent MicroRNA 155 Confers Competitive Fitness to Regulatory T Cells by Targeting SOCS1 Protein, CellPress, Immunity, 2008, No Volume Number, pp. 80-91.

Luo, Xunrong et al., Dendritic Cells with TGF-B1 Differentiate naïve CD4=CD25-T Cells Into Islet-Protective Foxp3+ Regulatory T Cells, PNAS, 2007, vol. 104, No. 8, pp. 2821-2826.

Mingozzi, Federico, et al., Pharmacological Modulation of Humoral Immunity in a Nonhuman Primate Model AAV Gene Transfer for Hemophilia B, The American Society of Gene & Cell Therapy, 2012, vol. 20, No. 7, pp. 1410-1416.

Peakman, Mark et al., Can We Vaccinate Against Type 1 Diabetes, F1000Reports Biology, 2012, No Volume no., pp. 1-8.

Roep, Bart et al., Antigen Targets of Type 1 Diabetes Autoimmunity, Cold Spring Harbor Perspectives in Medicine, 2013, No Vol., pp. 1-15.

Suciu-Foca, Nicole et al., Soluble IG-Like Transcript 3 Inhibits Tumor Allograft Rejection in Humanized SCID Mice and T Cell Responses in Cancer Patients, The Journal of Immunology, 2007, vol. 178, pp. 4732-7441.

Vlad, George et al., Immunoglobulin-Like Transcript 3-FC Suppresses T-Cell Responses to Allogeneic Human Islet Transplants in hu-NOD/SCID Mice, Diabetes, 2006, vol. 57, No number, pp. 1-9.

Wantabee, Hisayo et al., Experimental Autoimmune Thyroiditis Induced b Thyroglobulin-Pulsed Dendritic Cells, 1999, vol. 31, No. 4, pp. 273-282.

Wing, Kajsa et al., Regulatory T Cells Exert Checks and Balances on Self Tolerance and Autoimmunity, Nature Immunology, 2010, vol. 11, No. 1, pp. 1-8.

Yang, Junbao et al., CD+Tcells from Type 1 Diabetic and Healthy Subjects Exhibit Different Thresholds of Activation to a Naturally Processed Proinsulin Epitope, Journal of Autoimmunity, 2008, vol. 31, No Vol. number, pp. 30-41.

Taniguchi, Takashi et al., Serum Levels of Galectin-3: Possible Association with Fibrosis, Aberrant Angiogenesis, and Immune Activation in Patients with Systemic Sclerosis, The Journal of Rheumatology, 2012, vol. 39, No. 3, pp. 539-544.

(56) References Cited

OTHER PUBLICATIONS

Chen, Juine-Ruey, et al., Vaccination of Monoglycosylated Hemagglutinin Induces Cross-Strain Protection Against Influenza Virus Infection, PNAS, 2013, No Volume Number, pp. 1-6.
Apostolopoulos, Vasso et al., Targeting Antigens to Dendritic Cell Receptors for Vaccine Development, Hindawi Publishing Corporation Journal of Drug Delivery, 2013, vol. 201, Article ID 869718, pp. 1-22.
Deering, Raquel et al., Nucleic Acid Vaccines: Prospects for Non-Viral Delivery of mRNA Vaccines, Expert Opinion, 2014, vol. 11, No. 6, pp. 1-15.
Falugi, Fabiana et al., Role of Protien A in the Evasion of Host Adaptive Immune Responses by *Staphylococcus aureus*, mBio, 2014, vol. 4, Issue 5, pp. 1-10.
Geijtenbeek, Teunis et al., Identification of DC-SIGN, A Novel Dendritic Cell-Specific ICAM-3 Receptor That Supports Primary Immune Responses, Cell, 2000, vol. 100, pp. 575-585.
World Health Organization, Department of Communicable Disease Surveillance and Response, WHO/CSR, 2000, Chapter 7, pp. 1-7.
Gupta, Shivali et al., TcVac3 Induced Control of Trypanosoma Cruzi Infection and Chronic Myocarditis in Mice, PLOS One, 2013, vol. 8, Issue 3, pp. 1-16.
Nogueira, Raquel et al., Recombinant Yellow Fever Viruses Elicit CD8+ T Cell Responses and Protective Immunity Against Trypanosoma Cruzi, PLOS One, 2013, vol. 8, Issue 3, pp. 1-13.
Barr, Ian et al., Epidemiological, Antigen and Genetic Characteristics of Seasonal Influenza a(H1N1), A (H3N2) and B Influenza Virus: Basis for WHO Recommendation on the Competition of Influenza Vaccines for Using in the 2009-2010 Northern Hemisphere Season, Vaccine, 2010, vol. 28, No number, pp. 1156-1167.
Kim, Hwan Keun et al., Nontoxigenic Protein A Vaccine for Methicillin-Resistant Staphylococcus Aureus Infections in Mice, The Journal of Experimental Medicine, 2010, vol. 207, No. 9, pp. 1863-1870.
Lee, Justin B. et al., Lipid Nanoparticle siRNA Systems for Silencing the Androgen Receptor in Human Prostate Cancer in Vivo, International Journal of Cancer, 2012, vol. 131, pp. 781-790.
Brandenburg, Boerries et al., Mechanisms of Hemagglutinin Targeted Influenza Virus Neutralization, PLOS One, 2013, vol. 8, Issue 12, pp. 1-14.
Messer, William B. et al., Dengue Virus Envelope Protein Domain I/II Hinge Determines long-livid Serotype-Specific Dengue Immunity, PNAS, 2014, vol. 111, No. 5, 1939-1944.
Metz, Bernard et al, Identification of Formaldehyde-induced Modifications in Proteins, The Journal of Biological Chemistry, 2004,vol. 279, No. 8, pp. 6235-6243.
Mohamadzadeh, M et al., Dendritic Cell Targeting of Bacillus Anthracis Protective Antigen Expressed by Lactobacillus Acidophilus Protects Mice From Lethal Challenge, PNAS, 2009, vol. 106, No. 11, pp. 4331-4336.
Perez-Velez, Mariel et al., Induction of Neutralization Antibodies in Mice by Dengue-2 Envelope DNA Vaccines, National Institutes of Health, PR Health Sci, 2009, vol. 28, No. 3, pp. 239-250.
Ramanathan, Mathura et al., Development of Novel DNA SynCon Tetravalent Dengue Vaccine That Elicits Immune Responses Against Four Serotypes, Vaccine, 2009, vol. 27, No Number, pp. 6444-6453.
Schroeder, Ulrich et al., Peptide Nanoparticles Serve as a Powerful Platform for the Immunogenic Display of Poorly Antigenic Actin Determinants, Science Direct, J. Mol. Biol., 2009, vol. 386, No vol. Number, pp. 1368-1381.
Arce-Fonseca, Minerva et al., Specific Humoral and Cellular Immunity Induced by Trypanosoma cruzi DNA Immunization in a Canine Model, Veterinary Research, 2013, vol. 44, No. 15, pp. 2-9.
Steel, John et 1., Influenza Virus Vaccine Based on the Conserved Hemagglutinin Stalk Domain, mBio, 2010, vol. 1, Issue 1, pp. 1-10.
Walker, Andreas et al., SplitCore: An Exceptionally Versatile Viral NanoParticles for Native Whole Protein Display Regardless of 3D Structure, Scientific Reporters, 2011, vol. 1, No. 5, pp. 1-8.
World Health Organization, WHO Manual on Animal Influenza Diagnosis and Surveillance, WHO Global Influenza Programme, CDS, CSR, NCS, 2002, vol. 5, No Number, pp. 1-99.
World Health Organization, Serological Diagnosis of Influenza by Microneutralization Assay, 2010, No Vol., pp. 1-25.
Coller, Barry S. et al, A New Murine Monoclonal Antibody Reports an Activation-Dependent Change in the Confirmation and/or Microenvironment of the Platelet Glycoprotein IIb/IIIa Complex, The American Society for Clinical Investigation, Inc., 1985, vol. 76, No Volume number, pp. 101-108.
Coller, BS et al., Inhibition of Dog Platelet Function by Vivo Infusion of F (ab')2 Fragments of a Monoclonal Antibody to Platelet Glycoprotien IIb/IIIa Receptor, Blood, 1985, vol. 66, No. 6, pp. 1456-1459.
Ellis, SG et al., Safety and Antiplatelet Effect of Murine Monoclonal Antibody 7E3 Fab Directed Against Platelet Glycoprotein IIb/IIIA in Patients Undergoing Elective Coronary Angioplasty, Coron Artery Dis., 1993, vol. 4, No. 2, pp. 167-175.
Abciximab (ReoPro)FDA Description, Jan. 4, 1997, No Volume number, pp. 1-17.
Califf, Robert et al., Use of a Monoclonal Antibody Directed Against the Platelet Glycoprotein IIB/IIIa Receptor in High-Risk Coronary Angioplasty, 1994, The New England Journal of Medicine, vol. 330, No. 14, pp. 1-6.
Bolukbasi et al., miR-1289 and "Zipcode"-like Sequence Enrich mRNAs in Microvesicles. Mol Ther Nucleic Acids. Feb. 7, 2012;1:e10. doi: 10.1038/mtna.2011.2.
Chappell et al., Biochemical and functional analysis of a 9-nt RNA sequence that affects translation efficiency in eukaryotic cells. Proc Natl Acad Sci U S A. Jun. 29, 2004;101(26):9590-4. Epub Jun. 21, 2004.
Fan et al., Overexpression of HuR, a nuclear-cytoplasmic shuttling protein, increases the in vivo stability of ARE-containing mRNAs. EMBO J. Jun. 15, 1998;17(12):3448-60.
Karijolich et al., Converting nonsense codons into sense codons by targeted pseudouridylation. Nature. Jun. 15, 2011;474(7351):395-8. doi: 10.1038/nature10165.
Kedde et al., A Pumilio-induced RNA structure switch in p27-' UTR controls miR-221 and miR-222 accessibility. Nat Cell Biol. Oct. 2010;12(10):1014-20. doi: 10.1038/ncb2105. Epub Sep. 5, 2010.
Kore et al., Synthesis and biological validation of $N^7$-(4-chlorophenoxyethyl) substituted dinucleotide cap analogs for mRNA translation. Bioorg Med Chem. Aug. 1, 2013;21(15):4570-4. doi: 10.1016/j.bmc.2013.05.041. Epub Jun. 1, 2013.
Leppek et al., Roquin promotes constitutive mRNA decay via a conserved class of stem-loop recognition motifs. Cell. May 9, 2013;153(4):869-81. doi: 10.1016/j.cell.2013.04.016.
Matsuda et al., Determinants of initiation codon selection during translation in mammalian cells. PLoS One. Nov. 24, 2010;5(11):e15057. doi: 10.1371/journal.pone.0015057.
Meijer et al., Translational repression and eIF4A2 activity are critical for microRNA-mediated gene regulation. Science. Apr. 5, 2013;340(6128):82-5. doi: 10.1126/science.1231197.
Parisien et al., Rationalization and prediction of selective decoding of pseudouridine-modified nonsense and sense codons. RNA. Mar. 2012;18(3):355-67. doi: 10.1261/rna.031351.111. Epub Jan. 26, 2012.
Pánek et al., An evolutionary conserved pattern of 18S rRNA sequence complementarity to mRNA 5' UTRs and its implications for eukaryotic gene translation regulation. Nucleic Acids Res. Sep. 2013;41(16):7625-34. doi: 10.1093/nar/gkt548. Epub Jun. 26, 2013.
Peart et al., Non-mRNA 3' end formation: how the other half lives. Wiley Interdiscip Rev RNA. Sep.-Oct. 2013;4(5):491-506. doi: 10.1002/wrna.1174. Epub Jun. 10, 2013. Review.
Ray et al., A compendium of RNA-binding motifs for decoding gene regulation. Nature. Jul. 11, 2013;499(7457):172-7. doi: 10.1038/nature12311.
Wellensiek et al., Genome-wide profiling of human cap-independent translation-enhancing elements. Nat Methods. Aug.

(56) References Cited

OTHER PUBLICATIONS

2013;10(8):747-50. doi: 10.1038/nmeth.2522. Epub Jun. 16, 2013.
Wellensiek et al., Supplementary Information for Genome-wide profiling of human cap-independent translation-enhancing elements. Nat Methods. 2013. 30 pages.

Wilusz et al., 3' end processing of a long nuclear-retained noncoding RNA yields a tRNA-like cytoplasmic RNA. Cell. Nov. 28, 2008;135(5):919-32. doi: 10.1016/j.cell.2008.10.012.
Zhou et al., A positive feedback vector for identification of nucleotide sequences that enhance translation. Proc Natl Acad Sci U S A. May 3, 2005;102(18):6273-8. Epub Apr. 21, 2005.

* cited by examiner

ENGINEERED NUCLEIC ACIDS AND METHODS OF USE THEREOF

CROSS REFERENCE TO RELATED APPLICATIONS

This application is a continuation of U.S. application Ser. No. 14/342,905, filed Mar. 5, 2014, now abandoned, which is a national phase filing under 35 U.S.C. §371 of International Application No. PCT/US2012/54561, filed Sep. 11, 2012, and claims priority to U.S. Provisional Application No. 61/533,537, filed Sep. 12, 2011, entitled Engineered Nucleic Acids and Methods of Use Thereof, the contents of each which are incorporated by reference in their entireties.

REFERENCE TO THE SEQUENCE LISTING

The present application is being filed along with a Sequence Listing in electronic format. The Sequence Listing is provided as a file entitled M006USCONSEQLST.txt created on Nov. 4, 2014 which is 1,397,330 bytes in size. The information in electronic format of the sequence listing is incorporated herein by reference in its entirety.

REFERENCE TO LENGTHY TABLE

The specification includes a lengthy Table 1. Lengthy Table 1 has been submitted via EFS-Web in electronic format as follows: File name: Table.txt, Date created: Nov. 4, 2014; File size: 368,283 Bytes and is incorporated herein by reference in its entirety. Please refer to the end of the specification for access instructions.

disclosure belongs. Although methods and materials similar or equivalent to those described herein can be used in the practice or testing of the present disclosure, suitable methods and materials are described herein. The materials, methods, and examples are illustrative only and not intended to be limiting. Other features of the disclosure are apparent from the following detailed description and the claims.

SUMMARY OF THE INVENTION

Provided herein are modified nucleic acids encoding anti-microbial polypeptides (AMPs) (e.g., anti-bacterial polypeptides), e.g., anti-microbial polypeptides described herein, precursors thereof, or partially or fully processed forms of these precursors. In certain embodiments, the anti-microbial polypeptide is an anti-bacterial polypeptide. In certain embodiments, the anti-microbial polypeptide is an anti-fungal polypeptide. In certain embodiments, the anti-microbial polypeptide is an anti-viral polypeptide. In certain embodiments, the anti-microbial polypeptide is an anti-protozoal polypeptide. In certain embodiments, the anti-microbial polypeptide is an anti-tumor/cancer polypeptide. In certain embodiment, the anti-microbial polypeptide is an anti-parasitic polypeptide. In certain embodiment, the anti-microbial polypeptide is an anti-prion polypeptide. In certain embodiments, the anti-microbial polypeptide has one or more of anti-bacterial, anti-fungal, anti-viral, anti-protozoal, anti-tumor/cancer, anti-parasitic, or anti-prion activity. In certain embodiments, the modified nucleic acid comprises mRNA. In particular embodiments, the modified mRNA (mmRNA) is derived from cDNA. In certain embodiments,

LENGTHY TABLES

The patent contains a lengthy table section. A copy of the table is available in electronic form from the USPTO web site (http://seqdata.uspto.gov/?pageRequest=docDetail&DocID=US09464124B2). An electronic copy of the table will also be available from the USPTO upon request and payment of the fee set forth in 37 CFR 1.19(b)(3).

BACKGROUND OF THE INVENTION

Naturally occurring RNAs are synthesized from four basic ribonucleotides: ATP, CTP, UTP and GTP, but may contain post-transcriptionally modified nucleotides. Further, over one hundred natural nucleotide modifications have been identified in all RNA species (Rozenski, J, Crain, P, and McCloskey, J. (1999). The RNA Modification Database: 1999 update. Nucl Acids Res 27: 196-197). Nucleotides are modified in RNA to alter functional, structural, or catalytic roles of the parent RNA molecule. More recently, nucleotide modifications have been described to play a role in differentiating host cell RNA species from invading pathogenic RNA species. However, the precise mechanism by which nucleotide modifications alter the host immune response machinery and subsequently affect the translation efficiency of mRNA is unclear.

There is a need in the art for biological modalities to address the modulation of intracellular translation of nucleic acids.

Unless explained otherwise, all technical and scientific terms used herein have the same meaning as commonly understood to one of ordinary skill in the art to which this the mmRNA comprises at least two nucleoside modifications. In certain embodiments, these nucleoside modifications are 5-methylcytosine and pseudouridine.

Provided herein are isolated nucleic acids (e.g., modified mRNAs encoding an anti-microbial polypeptide described herein) comprising a translatable region and at least two different nucleoside modifications, wherein the nucleic acid exhibits reduced degradation in a cell into which the nucleic acid is introduced, relative to a corresponding unmodified nucleic acid. For example, the degradation rate of the nucleic acid is reduced by at least 10%, 20%, 30%, 40%, 50%, 60%, 70%, 80%, or 90%, compared to the degradation rate of the corresponding unmodified nucleic acid. In certain embodiments, the nucleic acid comprises RNA, DNA, TNA, GNA, or a hybrid thereof. In certain embodiments, the nucleic acid comprises messenger RNA (mRNA). In certain embodiments, the mRNA does not substantially induce an innate immune response of the cell into which the mRNA is introduced. In certain embodiments, the mRNA comprises at least one nucleoside selected from the group consisting of pyridin-4-one ribonucleoside, 5-aza-uridine, 2-thio-5-aza-uridine, 2-thiouridine, 4-thio-pseudouridine, 2-thio-pseudouridine, 5-hydroxyuridine, 3-methyluridine, 5-carboxymethyl-uridine, 1-carboxymethyl-pseudouridine, 5-propynyl-uridine, 1-propynyl-pseudouridine, 5-taurinomethyluridine, 1-taurinomethyl-pseudouridine, 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-1-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxyuridine, 2-methoxy-4-thio-uridine, 4-methoxy-pseudouridine, and 4-methoxy-2-thio-pseudouridine. In certain embodiments, the mRNA comprises at least one nucleoside selected from the group consisting of 5-aza-cytidine, pseudoisocytidine, 3-methyl-cytidine, N4-acetylcytidine, 5-formylcytidine, N4-methylcytidine, 5-hydroxymethylcytidine, 1-methyl-pseudoisocytidine, pyrrolo-cytidine, pyrrolo-pseudoisocytidine, 2-thio-cytidine, 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, and 4-methoxy-1-methyl-pseudoisocytidine. In other embodiments, the mRNA comprises at least one nucleoside selected from the group consisting of 2-aminopurine, 2,6-diaminopurine, 7-deaza-adenine, 7-deaza-8-aza-adenine, 7-deaza-2-aminopurine, 7-deaza-8-aza-2-aminopurine, 7-deaza-2,6-diaminopurine, 7-deaza-8-aza-2,6-diaminopurine, 1-methyladenosine, N6-methyladenosine, N6-isopentenyladenosine, N6-(cis-hydroxyisopentenyl)adenosine, 2-methylthio-N6-(cis-hydroxyisopentenyl) adenosine, N6-glycinylcarbamoyladenosine, N6-threonylcarbamoyladenosine, 2-methylthio-N6-threonyl carbamoyladenosine, N6,N6-dimethyladenosine, 7-methyladenine, 2-methylthio-adenine, and 2-methoxy-adenine. In yet other embodiments, the mRNA comprises at least one nucleoside selected from the group consisting of inosine, 1-methyl-inosine, wyosine, wybutosine, 7-deaza-guanosine, 7-deaza-8-aza-guanosine, 6-thio-guanosine, 6-thio-7-deaza-guanosine, 6-thio-7-deaza-8-aza-guanosine, 7-methyl-guanosine, 6-thio-7-methyl-guanosine, 7-methylinosine, 6-methoxy-guanosine, 1-methylguanosine, N2-methylguanosine, N2,N2-dimethylguanosine, 8-oxo-guanosine, 7-methyl-8-oxo-guanosine, 1-methyl-6-thio-guanosine, N2-methyl-6-thio-guanosine, and N2,N2-dimethyl-6-thio-guanosine.

In some embodiments, the nucleic acids provided herein comprise a 5' untranslated region (UTR) and/or a 3'UTR, wherein each of the two different nucleoside modifications are independently present in the 5'UTR and/or 3'UTR. In some embodiments, nucleic acids are provided herein, wherein at least one of the two different nucleoside modifications are present in the translatable region. In some embodiments, nucleic acids provided herein are capable of binding to at least one polypeptide that prevents or reduces an innate immune response of a cell into which the nucleic acid is introduced.

Further provided herein are isolated nucleic acids (e.g., modified mRNAs described herein) comprising (i) a translatable region encoding an anti-microbial polypeptide (e.g., an anti-bacterial polypeptide), e.g., an anti-microbial polypeptide described herein, (ii) at least one nucleoside modification, and (iii) at least one intronic nucleotide sequence capable of being excised from the nucleic acid.

Further provided herein are isolated nucleic acids (e.g., modified mRNAs described herein) comprising (i) a translatable region encoding an anti-microbial polypeptide (e.g., an anti-bacterial polypeptide), e.g., an anti-microbial polypeptide described herein, (ii) at least two different nucleoside modifications, and (iii) a degradation domain.

Further provided herein are isolated nucleic acids (e.g., modified mRNAs described herein) comprising (i) a translatable region encoding an anti-microbial polypeptide (e.g., an anti-bacterial polypeptide), e.g., an anti-microbial polypeptide described herein, and (ii) at least two different nucleoside modifications, wherein the translatable region encodes a polypeptide variant having an altered activity relative to a reference polypeptide. In certain embodiments, isolated mRNAs are provided, wherein the altered activity comprises an increased activity or wherein the altered activity comprises a decreased activity.

Further provided herein are non-enzymatically synthesized nucleic acids (e.g., modified mRNAs described herein) comprising at least one nucleoside modification, and comprising a translatable region encoding an anti-microbial polypeptide (e.g., an anti-bacterial polypeptide), e.g., an anti-microbial polypeptide described herein. In certain embodiments, the non-enzymatically synthesized mRNA comprises at least two different nucleoside modifications.

Further provided herein are isolated nucleic acids (e.g., modified mRNAs described herein) comprising a noncoding region and at least one nucleoside modification that reduces an innate immune response of a cell into which the nucleic acid is introduced, wherein the nucleic acid sequesters one or more translational machinery components. In certain embodiments, the isolated nucleic acids comprising a non-coding region and at least one nucleoside modification described herein are provided in an amount effective to reduce protein expression in the cell. In certain embodiments, the translational machinery component is a ribosomal protein or a transfer RNA (tRNA). In certain embodiments, the nucleic acid comprises a small nucleolar RNA (snoRNA), microRNA (miRNA), small interfering RNA (siRNA) or Piwi-interacting RNA (piRNA).

Further provided herein are isolated nucleic acids (e.g., modified mRNAs described herein) comprising (i) a first translatable region, (ii) at least one nucleoside modification, and (iii) an internal ribosome entry site (IRES). In certain embodiments, the IRES is obtained from a picornavirus, a pest virus, a polio virus, an encephalomyocarditis virus, a foot-and-mouth disease virus, a hepatitis C virus, a classical swine fever virus, a murine leukemia virus, a simian immune deficiency virus or a cricket paralysis virus. In certain embodiments, the isolated nucleic acid further comprises a second translatable region. In certain embodiments, the isolated nucleic acid further comprises a Kozak sequence. In some embodiments, the first translatable region encodes an anti-microbial polypeptide (e.g., an anti-bacterial polypeptide), e.g., an anti-microbial polypeptide described herein. In some embodiments, the second translatable region encodes an anti-microbial polypeptide (e.g., an anti-bacterial polypeptide), e.g., an anti-microbial polypeptide described herein. In some embodiments, the first and the second translatable regions encode anti-microbial polypeptides (e.g., an anti-bacterial polypeptides), e.g., anti-microbial polypeptides described herein.

Further, provided herein are compositions (e.g., pharmaceutical compositions) comprising the modified nucleic acids described herein. In certain embodiments, the composition further comprises a pharmaceutically acceptable carrier. In certain embodiments, the composition is formulated for systemic or local administration. In certain embodiments, the composition is formulated for intravenous administration. In certain embodiments, the composition is formulated for oral administration. In certain embodiments, the composition is formulated for topical administration. In certain embodiments, the composition is formulated for administration via a dressing (e.g., wound dressing). In certain embodiments, the composition is formulated for administration via a bandage (e.g., adhesive bandage). In certain embodiments, the composition is formulated for administration by inhalation. In certain embodiments, the composition is formulated for rectal administration. In certain embodiments, the composition is formulated for vaginal administration. In certain embodiments, the composition comprises naked modified nucleic acids. In other embodiments, the modified nucleic acid is complexed or encapsulated. In another embodiment, the administration of the composition described herein may be administered at least once.

Provided herein are pharmaceutical compositions comprising: (i) an effective amount of a synthetic messenger ribonucleic acid (mRNA) encoding an anti-microbial polypeptide (e.g., an anti-bacterial polypeptide), e.g., an anti-microbial polypeptide described herein; and (ii) a pharmaceutically acceptable carrier, wherein i) the mRNA comprises pseudouridine, 5'methyl-cytidine, or a combination thereof, or ii) the mRNA does not comprise a substantial amount of a nucleotide or nucleotides selected from the group consisting of uridine, cytidine, and a combination of uridine and cytidine, and wherein the composition is suitable for repeated administration (e.g., intravenous administration) to a mammalian subject in need thereof. In some embodiments, the anti-microbial polypeptide (e.g., anti-bacterial polypeptide) is under 10 kDa, e.g., under 8 kDa, 6 kDa, 4 kDa, 2 kDa, or 1 kDa. In some embodiments, the anti-microbial polypeptide (e.g., anti-bacterial polypeptide) comprises or consists of from about 6 to about 100 amino acids, e.g., from about 6 to about 75 amino acids, about 6 to about 50 amino acids, about 6 to about 25 amino acids, about 25 to about 100 amino acids, about 50 to about 100 amino acids, or about 75 to about 100 amino acids. In certain embodiments, the anti-microbial polypeptide (e.g., anti-bacterial polypeptide) comprises or consists of from about 15 to about 45 amino acids. In some embodiments, the anti-microbial polypeptide (e.g., anti-bacterial polypeptide) is substantially cationic. In some embodiments, the anti-microbial polypeptide (e.g., anti-bacterial polypeptide) is substantially amphipathic. In certain embodiments, the anti-microbial polypeptide (e.g., anti-bacterial polypeptide) is substantially cationic and amphipathic. In some embodiments, the anti-microbial polypeptide (e.g., anti-bacterial polypeptide) is cytostatic to a Gram-positive bacterium. In some embodiments, the anti-microbial polypeptide (e.g., anti-bacterial polypeptide) is cytotoxic to a Gram-positive bacterium. In some embodiments, the anti-microbial polypeptide (e.g., anti-bacterial polypeptide) is cytostatic and cytotoxic to a Gram-positive bacterium. In some embodiments, the anti-microbial polypeptide (e.g., anti-bacterial polypeptide) is cytostatic to a Gram-negative bacterium. In some embodiments, the anti-microbial polypeptide (e.g., anti-bacterial polypeptide) is cytotoxic to a Gram-negative bacterium. In some embodiments, the anti-microbial polypeptide (e.g., anti-bacterial polypeptide) is cytostatic and cytotoxic to a Gram-negative bacterium. In some embodiments, the anti-microbial polypeptide is cytostatic to a virus, fungus, protozoan, parasite, prion, or a combination thereof. In some embodiments, the anti-microbial polypeptide is cytotoxic to a virus, fungus, protozoan, parasite, prion, or a combination thereof. In certain embodiments, the anti-microbial polypeptide is cytostatic and cytotoxic to a virus, fungus, protozoan, parasite, prion, or a combination thereof.

In some embodiments, the anti-microbial polypeptide is cytotoxic to a tumor or cancer cell (e.g., human tumor or cancer cell). In some embodiments, the anti-microbial polypeptide is cytostatic to a tumor or cancer cell (e.g., human tumor or cancer cell). In certain embodiments, the anti-microbial polypeptide is cytotoxic and cytostatic to a tumor or cancer cell (e.g., human tumor or cancer cell). In some embodiments, the anti-microbial polypeptide (e.g., anti-bacterial polypeptide) is a secreted polypeptide. In certain embodiments, the anti-microbial polypeptide (e.g., anti-bacterial polypeptide) is selected from the group consisting of anti-microbial polypeptides (e.g., anti-bacterial polypeptides) and/or SEQ ID NOs: 1-2915. In certain embodiments, the anti-microbial polypeptide (e.g., anti-bacterial polypeptide) comprises or consists of hBD-2 (SEQ ID NO: 191 or 192), LL-37 (SEQ ID NO: 6), or RNase-7 (SEQ ID NO: 262). In some embodiments, the composition (e.g., pharmaceutical composition) provided herein further comprises a lipid-based transfection reagent. In some embodiments, the synthetic messenger ribonucleic acid (mRNA) encoding an anti-microbial polypeptide (e.g., an anti-bacterial polypeptide), e.g., an anti-microbial polypeptide described herein, lacks at least one destabilizing element.

Further provided herein are pharmaceutical compositions comprising and/or consisting essentially of: (i) an effective amount of a synthetic messenger ribonucleic acid (mRNA) encoding an anti-microbial polypeptide (e.g., an anti-bacterial polypeptide), e.g., an anti-microbial polypeptide described herein; (ii) a cell penetration agent; and (iii) a pharmaceutically acceptable carrier, wherein i) the mRNA comprises pseudouridine, 5'methyl-cytidine or a combination thereof, or ii) the mRNA does not comprise a substantial amount of a nucleotide or nucleotides selected from the group consisting of uridine, cytidine, and a combination of uridine and cytidine, and wherein the composition is suitable for repeated administration (e.g., intravenous administration) to an animal (e.g., mammalian) subject in need thereof.

Provided herein are methods of treating a subject having and/or being suspected of having a microbial infection (e.g., a bacterial infection) and/or a disease, disorder, or condition, e.g., a disease, disorder, or condition associated with a microbial infection (e.g., a bacterial infection), the methods comprising administering to a subject in need of such treatment a composition described herein in an amount sufficient to treat the microbial infection and/or the disease, disorder, or condition. In specific embodiments, the disease, disorder, or condition is associated with one or more cellular and/or molecular changes affecting, for example, the level, activity, and/or localization of an anti-microbial polypeptide (e.g., an anti-bacterial polypeptide), e.g., an anti-microbial polypeptide described herein, precursors thereof, or a partially or fully processed form of these precursors. In certain embodiments, the method of treating a subject having or being suspected of having a microbial infection (e.g., a bacterial infection) and/or a disease, disorder, or condition, e.g., a disease, disorder, or condition associated with a microbial infection (e.g., a bacterial infection), comprises administering to the subject in need of such treatment a composition comprising a modified nucleic acid described herein in an amount sufficient to kill or reduce the growth of microorganisms (e.g., bacteria, fungi, viruses, protozoan, parasites, prions, or a combination thereof), to kill or reduce the growth of tumor/cancer cells, and/or to modulate one or more activities associated with, therefore to treat the microbial infection and/or the disease, disorder, or condition in the subject.

Further provided herein are methods of treating and/or preventing a microbial infection (e.g., a bacterial infection) of a target animal cell (e.g., mammalian cell), comprising the step of contacting the target animal cell (e.g., mammalian cell) with a composition comprising a synthetic messenger ribonucleic acid (mRNA) encoding an anti-microbial polypeptide (e.g., an anti-bacterial polypeptide) in an amount effective to be cytostatic and/or cytotoxic to one or more microorganisms (e.g., bacteria) infecting the target animal cell (e.g., mammalian cell). In some embodiments, the composition is effective to be cytostatic and/or cytotoxic to one or more microorganisms (e.g., bacteria) adjacent to the target animal cell (e.g., mammalian cell). In some embodiments, the target animal cell (e.g., mammalian cell) is present in an animal subject (e.g., a mammalian subject). In certain embodiments, the subject is a human. In certain embodiments, the subject is a livestock animal. In some embodiments, the composition is administered to the subject by an intravenous route. In certain embodiments, the composition is administered to the subject orally. In certain embodiments, the composition is administered to the subject topically. In certain embodiments, the composition is administered to the subject by inhalation. In certain embodiments, the composition is administered to the subject rectally. In certain embodiments, the composition is administered to the subject vaginally. In certain embodiments, the method further comprises the step of administering an effective amount of an anti-microbial agent (e.g., an anti-bacterial agent), e.g., an anti-microbial agent described herein, to the subject at the same time or at a different time from the administering the composition, e.g., before or after the administering the composition. In some embodiments, the anti-microbial agent is an anti-microbial polypeptide, e.g., a microbial polypeptide described herein. In some embodiments, the anti-microbial agent is a small molecule anti-microbial agent, e.g., a small molecule anti-microbial agent described herein. In another embodiment, the administration of the composition described herein may be administered at least once.

Further provided herein are methods for treating and/or preventing a microbial infection (e.g., a bacterial infection) and/or a disease, disorder, or condition associated with a microbial infection (e.g., a bacterial infection), and/or a symptom thereof, in a animal (e.g., a mammalian) subject, comprising contacting a cell of the subject with a nucleic acid described herein, wherein the translatable region of the nucleic acid encodes an anti-microbial polypeptide (e.g., an anti-bacterial polypeptide), under conditions such that an effective amount of the anti-microbial polypeptide (e.g., an anti-bacterial polypeptide) is present in the cell, thereby treating or preventing a microbial infection (e.g., bacterial infection) and/or a disease, disorder, or condition associated with the microbial infection (e.g., bacterial infection), and/or a symptom thereof, in the subject. In certain embodiments, the cell is an epithelial cell, an endothelial cell, or a mesothelial cell. In certain embodiments, the nucleic acid comprises an RNA molecule formulated for administration by an intravenous route. In certain embodiments, the nucleic acid comprises an RNA molecule formulated for oral administration. In certain embodiments, the nucleic acid comprises an RNA molecule formulated for topical administration. In certain embodiments, the nucleic acid comprises an RNA molecule formulated for administration by inhalation. In certain embodiments, the nucleic acid comprises an RNA molecule formulated for rectal administration. In certain embodiments, the nucleic acid comprises an RNA molecule formulated for vaginal administration.

Further provided herein are methods for inducing in vivo translation of a recombinant polypeptide (e.g., an anti-microbial polypeptide (e.g., an anti-bacterial polypeptide), e.g., an anti-microbial polypeptide described herein) in an animal (e.g., a mammalian) subject in need thereof, comprising the step of administering to the subject an effective amount of a composition comprising a nucleic acid comprising: (i) a translatable region encoding the recombinant polypeptide; and (ii) at least one nucleoside modification, under conditions such that the nucleic acid is localized into a cell of the subject and the recombinant polypeptide is capable of being translated in the cell from the nucleic acid. In certain embodiments, the composition comprises mRNA. In certain embodiments, methods are provided, wherein the recombinant polypeptide comprises a functional activity substantially absent in the cell in which the recombinant polypeptide is translated. In certain embodiments, the recombinant polypeptide comprises a polypeptide substantially absent in the cell in the absence of the composition. In certain embodiments, the recombinant polypeptide comprises a polypeptide that antagonizes the activity of an endogenous protein present in, on the surface of, or secreted from the cell. In certain embodiments, the recombinant polypeptide comprises a polypeptide that antagonizes the activity of a biological moiety present in, on the surface of, or secreted from the cell. In certain embodiments, the biological moiety comprises a lipid, a lipoprotein, a nucleic acid, a carbohydrate, or a small molecule toxin. In certain embodiments, the recombinant polypeptide is capable of being secreted from the cell. In certain embodiments, the recombinant polypeptide is capable of being translocated to the plasma membrane of the cell. In certain embodiments, methods are provided, wherein the composition is formulated for administration intramuscularly, transarterially, intraperitoneally, intravenously, intranasally, subcutaneously, endoscopically, transdermally, or intrathecally. In certain embodiments, methods are provided, wherein the composition is formulated for extended release.

Further provided herein are methods for inducing translation of a recombinant polypeptide (e.g., an anti-microbial polypeptide (e.g., an anti-bacterial polypeptide), e.g., an anti-microbial polypeptide described herein) in a cell population, comprising the step of contacting the cell population with an effective amount of a composition comprising a nucleic acid comprising: (i) a translatable region encoding the recombinant polypeptide; and (ii) at least one nucleoside modification, under conditions such that the nucleic acid is localized into one or more cells of the cell population and the recombinant polypeptide is translated in the cell from the nucleic acid. In certain embodiments, methods are provided, wherein the composition comprises mRNA. In certain embodiments, the composition comprises a cell penetrating compound. In certain embodiments, methods are provided, wherein the step of contacting the cell with the composition is repeated one or more times. In certain embodiments, the step of contacting the cell with the composition is repeated a sufficient number of times such that a predetermined efficiency of protein translation in the cell population.

Further provided herein are methods of reducing the innate immune response of a cell to an exogenous nucleic acid (e.g., a modified mRNA described herein), comprising the steps of: (a) contacting the cell with a first composition comprising a first dose of a first exogenous nucleic acid comprising a translatable region (e.g., encoding an anti-microbial polypeptide (e.g., an anti-bacterial polypeptide), e.g., an anti-microbial polypeptide described herein) and at least one nucleoside modification; (b) determining the level of the innate immune response of the cell to the first exogenous nucleic acid; (c) contacting the cell with a second composition comprising either: (i) a second dose of the first exogenous nucleic acid, wherein the second dose contains a lesser amount of the first exogenous nucleic acid as compared to the first dose; or (ii) a first dose of a second exogenous nucleic acid, thereby reducing the innate immune response of the cell. In certain embodiments, methods are provided, wherein the step of contacting the cell with the first composition and/or the second composition is repeated one or more times. In certain embodiments, a predetermined efficiency of protein translation in the cell is achieved.

Provided herein are methods of providing a composition (e.g., a composition described herein) to a target tissue of a subject (e.g., a mammalian subject) in need thereof, comprising the step of contacting the target tissue comprising one or more target cells with the composition under conditions such that the composition is substantially retained in the target tissue, and wherein the composition comprises: (a) an effective amount of a ribonucleic acid, wherein the ribonucleic acid is engineered to avoid an innate immune response of a cell into which the ribonucleic acid enters, and wherein the ribonucleic acid comprises a nucleotide sequence encoding a polypeptide of interest (e.g., a anti-microbial polypeptide described herein), wherein the protein of interest has an anti-microbial activity; (b) optionally, a cell penetration agent; and (c) a pharmaceutically acceptable carrier, under conditions such that the polypeptide of interest is produced in at least one target cell.

Further provided herein are isolated polypeptides (e.g., anti-microbial polypeptides (e.g., anti-bacterial polypeptides), e.g., anti-microbial polypeptides described herein) produced by translation of the mRNAs described herein.

Further provided herein are isolated complexes comprising a conjugate of a protein and a nucleic acid (e.g., a nucleic acid described herein), comprising (i) an mRNA comprising a translatable region encoding an anti-microbial polypeptide (e.g., an anti-bacterial polypeptide), e.g., an anti-microbial polypeptide described herein, and at least two different nucleoside modifications; and (ii) one or more polypeptides bound to the mRNA in an amount effective to prevent or reduce an innate immune response of a cell into which the complex is introduced.

Further provided herein are libraries comprising a plurality of polynucleotides, wherein the polynucleotides individually comprise: (i) a nucleic acid sequence encoding a polypeptide (e.g., an anti-microbial polypeptide (e.g., an anti-bacterial polypeptide), e.g., an anti-microbial polypeptide described herein); and (ii) at least one nucleoside modification. In certain embodiments, libraries are provided, wherein the polypeptide comprises an antibody or functional portion thereof. In certain embodiments, libraries are provided, wherein the polynucleotides comprise mRNA. In certain embodiments, libraries are provided, wherein the at least one nucleoside modification is selected from the group consisting of pyridin-4-one ribonucleoside, 5-aza-uridine, 2-thio-5-aza-uridine, 2-thiouridine, 4-thio-pseudouridine, 2-thio-pseudouridine, 5-hydroxyuridine, 3-methyluridine, 5-carboxymethyl-uridine, 1-carboxymethyl-pseudouridine, 5-propynyl-uridine, 1-propynyl-pseudouridine, 5-taurinomethyluridine, 1-taurinomethyl-pseudouridine, 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-1-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxyuridine, 2-methoxy-4-thio-uridine, 4-methoxy-pseudouridine, 4-methoxy-2-thio-pseudouridine, 5-aza-cytidine, pseudoisocytidine, 3-methyl-cytidine, N4-acetylcytidine, 5-formylcytidine, N4-methylcytidine, 5-hydroxymethylcytidine, 1-methyl-pseudoisocytidine, pyrrolo-cytidine, pyrrolo-pseudoisocytidine, 2-thio-cytidine, 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, 4-methoxy-1-methyl-pseudoisocytidine, 2-aminopurine, 2,6-diaminopurine, 7-deaza-adenine, 7-deaza-8-aza-adenine, 7-deaza-2-aminopurine, 7-deaza-8-aza-2-aminopurine, 7-deaza-2,6-diaminopurine, 7-deaza-8-aza-2,6-diaminopurine, 1-methyladenosine, N6-methyladenosine, N6-isopentenyladenosine, N6-(cis-hydroxyisopentenyl)adenosine, 2-methylthio-N6-(cis-hydroxyisopentenyl) adenosine, N6-glycinylcarbamoyladenosine, N6-threonylcarbamoyladenosine, 2-methylthio-N6-threonyl carbamoyladenosine, N6,N6-dimethyladenosine, 7-methyladenine, 2-methylthio-adenine, 2-methoxy-adenine, inosine, 1-methyl-inosine, wyosine, wybutosine, 7-deaza-guanosine, 7-deaza-8-aza-guanosine, 6-thio-guanosine, 6-thio-7-deaza-guanosine, 6-thio-7-deaza-8-aza-guanosine, 7-methyl-guanosine, 6-thio-7-methyl-guanosine, 7-methylinosine, 6-methoxy-guanosine, 1-methylguanosine, N2-methyl-guanosine, N2,N2-dimethylguanosine, 8-oxo-guanosine, 7-methyl-8-oxo-guanosine, 1-methyl-6-thio-guanosine, N2-methyl-6-thio-guanosine, and N2,N2-dimethyl-6-thio-guanosine.

Further provided herein are methods for enhancing protein (e.g., an anti-microbial polypeptide (e.g., an anti-bacterial polypeptide), e.g., an anti-microbial polypeptide described herein) product yield in a cell culture process, comprising the steps of: (a) providing a cell culture comprising a plurality of host cells; (b) contacting the cell culture with a composition comprising a nucleic acid comprising a translatable region encoding an anti-microbial polypeptide (e.g., an anti-bacterial polypeptide), e.g., an anti-microbial polypeptide described herein), and at least one nucleoside modification, wherein the nucleic acid exhibits increased protein production efficiency in a cell culture into which the nucleic acid is introduced, relative to a corresponding unmodified nucleic acid. In certain embodiments, methods are provided, wherein the increased protein production efficiency comprises increased cell transfection. In certain embodiments, the increased protein production efficiency comprises increased protein translation from the nucleic acid. In certain embodiments, the increased protein production efficiency comprises decreased nucleic acid degradation. In certain embodiments, the increased protein production efficiency comprises reduced innate immune response of the host cell. In certain embodiments, methods are provided, wherein the cell culture comprises a fed-batch mammalian cell culture process.

Further provided herein are methods for optimizing expression of an engineered protein (e.g., an anti-microbial polypeptide (e.g., an anti-bacterial polypeptide), e.g., an anti-microbial polypeptide described herein) in a target cell, comprising the steps of: (a) providing a plurality of target cell types; (b) independently contacting with each of the plurality of target cell types an isolated nucleic acid comprising a translatable region encoding an engineered polypeptide and at least one nucleoside modification; and (c) detecting the presence and/or level of the engineered polypeptide in the plurality of target cell types, thereby optimizing expression of an engineered polypeptide in a target cell. In certain embodiments, the engineered polypeptide comprises a post-translational modification. In certain embodiments, the engineered polypeptide comprises a tertiary structure. In certain embodiments, methods are provided, wherein the target cell comprises a mammalian cell line.

Further provided herein are methods of antagonizing a biological pathway in a cell, e.g., a biological pathway associated with a microbial infection (e.g., a bacterial infection), comprising the step of contacting the cell with an effective amount of a composition comprising a nucleic acid comprising: (i) a translatable region encoding a recombinant polypeptide (e.g., an anti-microbial polypeptide (e.g., an anti-bacterial polypeptide), e.g., an anti-microbial polypeptide described herein); and (ii) at least one nucleoside modification, under conditions such that the nucleic acid is localized into the cell and the recombinant polypeptide is capable of being translated in the cell from the nucleic acid, wherein the recombinant polypeptide inhibits the activity of a polypeptide functional in the biological pathway. In certain embodiments, methods are provided, wherein the biological pathway is defective in a cell having a microbial infection (e.g., a bacterial infection) and/or in a disease, disorder or condition (e.g., a disease, disorder, or condition described herein) associated with a microbial infection (e.g., a bacterial infection).

Further provided herein are methods of agonizing a biological pathway in a cell, e.g. a biological pathway associated with a microbial infection (e.g., a bacterial infection), comprising the step of contacting the cell with an effective amount of a composition comprising a nucleic acid comprising: (i) a translatable region encoding a recombinant polypeptide (e.g., an anti-microbial polypeptide (e.g., an anti-bacterial polypeptide), e.g., an anti-microbial polypeptide described herein); and (ii) at least one nucleoside modification, under conditions such that the nucleic acid is localized into the cell and the recombinant polypeptide is capable of being translated in the cell from the nucleic acid, wherein the recombinant polypeptide induces the activity of a polypeptide functional in the biological pathway. In certain embodiments, the agonized biological pathway modulates an anti-microbial (e.g., anti-bacterial) activity. In certain embodiments, the biological pathway is reversibly agonized.

Further provided herein are methods for enhancing nucleic acid delivery into a cell population, comprising the steps of: (a) providing a cell culture comprising a plurality of host cells; (b) contacting the cell population with a composition comprising an enhanced nucleic acid comprising a translatable region encoding a polypeptide (e.g., an anti-microbial polypeptide (e.g., an anti-bacterial polypeptide), e.g., an anti-microbial polypeptide described herein) and at least one nucleoside modification, wherein the enhanced nucleic acid exhibits enhanced retention in the cell population, relative to a corresponding unmodified nucleic acid. In certain embodiments, methods are provided, wherein the retention of the enhanced nucleic acid is at least about 50% greater than the retention of the unmodified nucleic acid. In some embodiments, the retention of the enhanced nucleic acid is at least about 100% greater than the retention of the unmodified nucleic acid. In other embodiments, the retention of the enhanced nucleic acid is at least about 200% greater than the retention of the unmodified nucleic acid. In certain embodiments, methods are provided, wherein the step of contacting the cell with the composition is repeated one or more times.

Further provided herein are methods of nucleic acid co-delivery into a cell population, comprising the steps of: (a) providing a cell culture comprising a plurality of host cells; (b) contacting the cell population with a composition comprising: (i) a first enhanced nucleic acid comprising a translatable region encoding a polypeptide (e.g., an anti-microbial polypeptide (e.g., an anti-bacterial polypeptide), e.g., an anti-microbial polypeptide described herein) and at least one nucleoside modification; and (ii) a first unmodified nucleic acid, wherein the composition does not substantially induce an innate immune response of the cell population.

Further provided herein are methods of nucleic acid delivery into a cell population, comprising the steps of: (a) providing a cell culture comprising a plurality of host cells; (b) contacting the cell population with a first composition comprising: (i) a first enhanced nucleic acid comprising a translatable region encoding a recombinant polypeptide (e.g., an anti-microbial polypeptide (e.g., an anti-bacterial polypeptide), e.g., an anti-microbial polypeptide described herein) and at least one nucleoside modification; and (ii) a first unmodified nucleic acid, wherein the composition does not substantially induce an innate immune response of the cell population; and (c) contacting the cell population with a second composition comprising a first unmodified nucleic acid.

Further provided herein are kits comprising a composition (e.g., a pharmaceutical composition) comprising a modified mRNA encoding an anti-microbial polypeptide (e.g., an anti-bacterial polypeptide), e.g., an anti-microbial polypeptide described herein, in one or more containers, and instructions for use thereof.

Further provided here are kits for polypeptide production in a subject (e.g., a mammalian subject) suffering from or at risk of developing a microbial infection, comprising a first isolated nucleic acid comprising a translatable region and a nucleic acid modification, wherein the nucleic acid is capable of evading an innate immune response of a cell of the subject into which the first isolated nucleic acid is introduced, wherein the translatable region encodes a therapeutic polypeptide, e.g., a therapeutic polypeptide comprising an anti-microbial activity (e.g., a anti-microbial polypeptide described herein), and packaging and instructions therefore. In some embodiments, the instructions comprise instructions for the repeated administration of the first isolated nucleic acid to a cell or a population of cells. In some embodiments, the therapeutic polypeptide is useful in the treatment of an infection in the mammalian subject by a microbial pathogen. In some embodiments, the kit further comprises a second isolated nucleic acid comprising a translatable region. In some embodiments, the translatable region in the second isolated nucleic acid encodes an anti-microbial polypeptide (e.g., an anti-bacterial polypeptide), e.g., an anti-microbial polypeptide described herein. In some embodiments, the translatable region of the second isolated nucleic acid encodes the same anti-microbial polypeptide as the first isolated nucleic acid. In some embodiments, the translatable region of the second isolated nucleic acid encodes a different anti-microbial polypeptide than the first isolated nucleic acid. In some embodiments, the second nucleic acid comprises a nucleic acid modification. In some embodiments, the second nucleic acid does not comprise a nucleic acid modification.

Further provided herein are dressings (e.g., wound dressings) or bandages (e.g., adhesive bandages) comprising a pharmaceutical composition comprising a modified mRNA encoding an anti-microbial polypeptide (e.g., an anti-bacterial polypeptide), e.g., an anti-microbial polypeptide described herein.

DETAILED DESCRIPTION OF THE INVENTION

In general, exogenous nucleic acids, particularly viral nucleic acids, introduced into cells induce an innate immune response, resulting in interferon (IFN) production and cell death. However, it is of great interest for therapeutics, diagnostics, reagents and for biological assays to deliver a nucleic acid, e.g., a ribonucleic acid (RNA) inside a cell, either in vivo or ex vivo, such as to cause intracellular translation of the nucleic acid and production of the encoded protein. Of particular importance is the delivery and function of a non-integrative nucleic acid, as nucleic acids characterized by integration into a target cell are generally imprecise in their expression levels, deleteriously transferable to progeny and neighbor cells, and suffer from the substantial risk of mutation. Provided herein in part are nucleic acids encoding useful polypeptides capable of killing or reducing the growth of microorganisms (e.g., bacteria), killing or reducing the growth of tumor or cancer cells, and/or modulating a cell's function and/or activity, and methods of making and using these nucleic acids and polypeptides. As described herein, these nucleic acids are capable of reducing the innate immune activity of a population of cells into which they are introduced, thus increasing the efficiency of protein production in that cell population. Further, one or more additional advantageous activities and/or properties of the nucleic acids and proteins of the invention are described.

Provided herein are modified nucleic acids encoding an anti-microbial polypeptide (e.g., an anti-bacterial polypeptide), e.g., an anti-microbial polypeptide described herein, precursors thereof, or partially or fully processed forms of these precursors. In certain embodiments, the modified nucleic acid comprises mRNA. In particular embodiments, the modified mRNA (mmRNA) is derived from cDNA. In certain embodiments, the mmRNA comprises at least two nucleoside modifications. In certain embodiments, these nucleoside modifications comprise 5-methylcytosine and pseudouridine. In some embodiments, around 25%, around 50%, around 75%, or up to and including 100% of cytosine and uridine nucleotides of the modified nucleic acid are modified nucleotides. In certain embodiments, the mmRNA comprises a 5' cap structure and a 3' poly-A tail. In specific embodiments, the 5' cap structure is a Cap 1 structure. In specific embodiments, the poly-A tail comprises at least 10, 20, 30, 40, 50, 60, 70, 80, 90, 100, 110, 120, 130, 140, 150, 160, 170, 180, 190, or 200 nucleotides.

Further, provided herein are compositions comprising the modified nucleic acids described herein. In certain embodiments, the composition further comprises a pharmaceutically acceptable carrier. In certain embodiments, the carrier is formulated for systemic or local administration. In certain embodiments, the composition is formulated for intravenous administration. In certain embodiments, the composition is formulated for oral administration. In certain embodiments, the composition is formulated for topical administration. In certain embodiments, the composition is formulated for administration via a dressing (e.g., wound dressing). In certain embodiments, the composition is formulated for administration via a bandage (e.g., adhesive bandage). In certain embodiments, the composition is formulated for administration by inhalation. In certain embodiments, the composition is formulated for rectal administration. In certain embodiments, the composition is formulated for vaginal administration. In certain embodiments, the composition comprises naked modified nucleic acids. In other embodiments, the modified nucleic acid is complexed or encapsulated. For example, the modified nucleic acid may be complexed in liposomal form or may be encapsulated in a nanoparticle. In certain embodiments, the modified nucleic acid, the complex, or the nanoparticle further comprises one or more targeting moieties. These moieties can be used to target delivery in vivo to certain organs, tissues, or cells.

Provided herein are methods of treating a subject having or being suspected of having a microbial infection (e.g., a bacterial infection) and/or a disease, disorder, or condition associated with a microbial infection (e.g., a bacterial infection), the methods comprising administering to a subject in need of such treatment a composition described herein in an amount sufficient to treat the microbial infection (e.g., bacterial infection) and/or the disease, disorder, or condition associated with the microbial infection (e.g., bacterial infection). In specific embodiments, the disease, disorder, or condition is associated with one or more cellular and/or molecular changes affecting, for example, the level, activity, and/or localization of an anti-microbial polypeptide (e.g., an anti-bacterial polypeptide), e.g., an anti-microbial polypeptide described herein, precursors thereof, or a partially or fully processed form of these precursors. Cellular and/or molecular changes may affect transcription, translation, posttranslational modification, processing, folding, intra- and/or extracellular trafficking, intra- and/or extracellular stability/turnover, and/or signaling of one or more molecules associated with an anti-microbial (e.g., anti-bacterial) activity. In certain embodiments, activities associated with an anti-microbial polypeptide (e.g., an anti-bacterial polypeptide), e.g., an anti-microbial polypeptide described herein, are compromised, e.g., 90%, 80%, 70%, 60%, 50%, 40%, 30%, 20%, 10%, 5% or less of wild-type activity. In certain embodiments, the method of treating a subject having or being suspected of having a microbial infection (e.g., a bacterial infection) and/or a disease, disorder, or condition associated with a microbial infection (e.g., a bacterial infection) comprises administering to the subject in need of such treatment a composition comprising a modified nucleic acid described herein in an amount sufficient to kill, reduce, or inhibit the growth of microorganisms (e.g., bacteria) and/or to treat the disease, disorder, or condition.

A major drawback of many current treatments for diseases described herein is the necessity to produce anti-microbial agents (e.g., anti-bacterial agents) as polypeptides. Polypeptides are ordinarily expressed in and isolated from mammalian or bacterial cultures. Bacterial cultures and many cancer-derived cell culture systems do not faithfully recapitulate post-translational modifications, e.g., glycosylation and amidation, and protein precursors may not be fully processed. In some instances, the lack of posttranslational modification and processing influences the activity of the final protein product, its localization and/or its target specificity. In other instances, precursors and final cleavage products can have different physiological effects. For production of recombinant proteins, the polypeptide product that is effective for a particular treatment must usually be predetermined because the proteins if administered do not undergo any additional processing. Any modification that is vital for activity must also be present on the recombinant protein because they will not be added by the host when the recombinant proteins are administered. Recombinant protein production and purification is expensive and labor intensive. Protein expression host systems may harbor pathogens (e.g. viruses) that may contaminate the purified product. Proteins and particularly protein modifications are inherently unstable and require specific storage conditions and generally have a short shelf life. To be efficacious, recombinant proteins must be further modified, particularly by pegylation to avoid rapid degradation in vivo. Still, site-specific pegylation remains difficult because it can lead to loss of activity, loss of target specificity and/or protein aggregation. Veronese et al. Bioconjugate Chem. 18:1824-1830 (2007).

The modified mRNA molecules described herein do not share these problems. In comparison to recombinant proteins, they exhibit increased stability for shipping, handling and storage, are easy to mass produce, and when translated from the modified mRNA, the polypeptide can undergo an array of cell- and/or tissue-specific posttranslational processing, folding and modification.

Anti-Microbial Polypeptide

Anti-microbial polypeptides (AMPs) are small peptides of variable length, sequence and structure with broad spectrum activity against a wide range of microorganisms including bacteria, viruses, fungi, protozoa, parasites, prions, and tumor/cancer cells. See, e.g., Zaiou, J Mol Med, 2007; 85:317. It has been shown that AMPs have broad-spectrum of rapid onset of killing activities, with potentially low levels of induced resistance and concomitant broad anti-inflammatory effects. In some embodiments, the anti-microbial polypeptide (e.g., an anti-bacterial polypeptide) is under 10 kDa, e.g., under 8 kDa, 6 kDa, 4 kDa, 2 kDa, or 1 kDa. In some embodiments, the anti-microbial polypeptide (e.g., an anti-bacterial polypeptide) consists of from about 6 to about 100 amino acids, e.g., from about 6 to about 75 amino acids, about 6 to about 50 amino acids, about 6 to about 25 amino acids, about 25 to about 100 amino acids, about 50 to about 100 amino acids, or about 75 to about 100 amino acids. In certain embodiments, the anti-microbial polypeptide (e.g., an anti-bacterial polypeptide) consists of from about 15 to about 45 amino acids. In some embodiments, the anti-microbial polypeptide (e.g., an anti-bacterial polypeptide) is substantially cationic. In some embodiments, the anti-microbial polypeptide (e.g., an anti-bacterial polypeptide) is substantially amphipathic. In certain embodiments, the anti-microbial polypeptide (e.g., an anti-bacterial polypeptide) is substantially cationic and amphipathic. In some embodiments, the anti-microbial polypeptide (e.g., an anti-bacterial polypeptide) is cytostatic to a Gram-positive bacterium. In some embodiments, the anti-microbial polypeptide (e.g., an anti-bacterial polypeptide) is cytotoxic to a Gram-positive bacterium. In some embodiments, the anti-microbial polypeptide (e.g., an anti-bacterial polypeptide) is cytostatic and cytotoxic to a Gram-positive bacterium. In some embodiments, the anti-microbial polypeptide (e.g., an anti-bacterial polypeptide) is cytostatic to a Gram-negative bacterium. In some embodiments, the anti-microbial polypeptide (e.g., an anti-bacterial polypeptide) is cytotoxic to a Gram-negative bacterium. In some embodiments, the anti-microbial polypeptide (e.g., an anti-bacterial polypeptide) is cytostatic and cytotoxic to a Gram-positive bacterium. In some embodiments, the anti-microbial polypeptide is cytostatic to a virus, fungus, protozoan, parasite, prion, or a combination thereof. In some embodiments, the anti-microbial polypeptide is cytotoxic to a virus, fungus, protozoan, parasite, prion, or a combination thereof. In certain embodiments, the anti-microbial polypeptide is cytostatic and cytotoxic to a virus, fungus, protozoan, parasite, prion, or a combination thereof. In some embodiments, the anti-microbial polypeptide is cytotoxic to a tumor or cancer cell (e.g., a human tumor or cancer cell). In some embodiments, the anti-microbial polypeptide is cytostatic to a tumor or cancer cell (e.g., a human tumor or cancer cell). In certain embodiments, the anti-microbial polypeptide is cytotoxic and cytostatic to a tumor or cancer cell (e.g., a human tumor or cancer cell). In some embodiments, the anti-microbial polypeptide (e.g., an anti-bacterial polypeptide) is a secreted polypeptide.

AMPs have been isolated and described from a wide range of animals: microorganisms, invertebrates, plants, amphibians, birds, fish, and mammals (Wang et al., Nucleic Acids Res. 2009; 37 (Database issue):D933-7). For example, anti-microbial polypeptides are described in Antimicrobial Peptide Database (Wang et al., Nucleic Acids Res. 2009; 37 (Database issue):D933-7), CAMP: Collection of Anti-Microbial Peptides (Thomas et al., Nucleic Acids Res. 2010; 38 (Database issue):D774-80), U.S. Pat. Nos. 5,221,732, 5,447, 914, 5,519,115, 5,607,914, 5,714,577, 5,734,015, 5,798,336, 5,821,224, 5,849,490, 5,856,127, 5,905,187, 5,994,308, 5,998,374, 6,107,460, 6,191,254, 6,211,148, 6,300,489, 6,329,504, 6,399,370, 6,476,189, 6,478,825, 6,492,328, 6,514,701, 6,573,361, 6,573,361, 6,576,755, 6,605,698, 6,624,140, 6,638,531, 6,642,203, 6,653,280, 6,696,238, 6,727,066, 6,730,659, 6,743,598, 6,743,769, 6,747,007, 6,790,833, 6,794,490, 6,818,407, 6,835,536, 6,835,713, 6,838,435, 6,872,705, 6,875,907, 6,884,776, 6,887,847, 6,906,035, 6,911,524, 6,936,432, 7,001,924, 7,071,293, 7,078,380, 7,091,185, 7,094,759, 7,166,769, 7,244,710, 7,314,858, and U.S. Pat. No. 7,582,301, the contents of which are incorporated by reference in their entirety.

In certain embodiments, the anti-microbial polypeptide (e.g., anti-bacterial polypeptide) is selected from the group consisting of anti-microbial polypeptides (e.g., anti-bacterial polypeptides) provided in Lengthy Table 1. Shown in Lengthy Table 1, in addition to the name of the anti-microbial polypeptide (e.g., anti-bacterial polypeptide) is the definition of the polypeptide and the sequence and SEQ ID NO of the polypeptide.

Exemplary anti-microbial polypeptides also include, but not limited to hBD-2, LL-37, and RNase-7.

The human defensin hBD-2 is expressed throughout human epithelia. The sequence of the precursor peptide consists of 41 residues present in the mature peptide as well as a leader sequence of secreted peptide. Disruption of hBD-2 expression, as in cystic fibrosis, might be associated with recurrent infections of skin and other epithelia.

The anti-microbial peptide, LL-37 is processed from the cathelicidin precursor hCAP18. The inhibition of LL-37 expression by *Shigella* likely causes about 160 million people develop intestinal infections yearly, resulting in over 1 million deaths. It is a multifunctional effector molecule capable of directly killing pathogens, modulating the immune response, stimulating proliferation, angiogenesis, and cellular migration, inhibiting apoptosis, and is associated with inflammation. It may play a part in epithelial cell proliferation as a part in wound closure and that its reduction in chronic wounds impairs re-epithelialization and may contribute to their failure to heal.

RNAse-7 is a potent AMP that was identified in the skin, human kidney and urinary tract. The systemic delivery of this mRNAs will likely allow expression of natural for the body antibiotic polypeptides even in tissues which are not supposed to be under microbial attack at normal physiological stage but have that danger under disease conditions.

In some embodiments, the anti-microbial polypeptide comprises or consists of a defensin. Exemplary defensins include, but not limited to, α-defensins (e.g., neutrophil defensin 1, defensin alpha 1, neutrophil defensin 3, neutrophil defensin 4, defensin 5, defensin 6), β-defensins (e.g., beta-defensin 1, beta-defensin 2, beta-defensin 103, beta-defensin 107, beta-defensin 110, beta-defensin 136), and θ-defensins. In other embodiments, the anti-microbial polypeptide comprises or consists of a cathelicidin (e.g., hCAP 18).

The anti-microbial polypeptides described herein may block cell fusion and/or viral entry by one or more enveloped viruses (e.g., HIV, HCV). For example, the anti-microbial polypeptide can comprise or consist of a synthetic peptide corresponding to a region, e.g., a consecutive sequence of at least about 5, 10, 15, 20, 25, 30, 35, 40, 45, 50, 55, or 60 amino acids of the transmembrane subunit of a viral envelope protein, e.g., HIV-1 gp 120 or gp41. The amino acid and nucleotide sequences of HIV-1 gp 120 or gp41 are described in, e.g., Kuiken et al., (2008). "*HIV Sequence Compendium*", Los Alamos National Laboratory. In some embodiments, the anti-microbial polypeptide has at least about 75%, 80%, 85%, 90%, 95%, 100% sequence homology to the corresponding viral protein sequence. In certain embodiments, the anti-microbial polypeptide comprises or consists of enfuvirtide (FUZEON®): Ac-Tyr-Thr-Ser-Leu-Ile-His-Ser-Leu-Ile-Glu-Glu-Ser-Glu-Asn-Gln-Gln-Glu-Lys-Asn-Glu-Gln-Glu-Leu-Leu-Glu-Leu-Asp-Lys-Trp-Ala-Ser-Leu-Trp-Asn- Trp-Phe-NH$_2$ (SEQ ID NO: 178).

The anti-microbial polypeptides described herein may block viral particle assembly and formation of one or more infective enveloped viruses (e.g., HIV, HCV). For example, the anti-microbial polypeptide can comprise or consist of a synthetic peptide corresponding to a region, e.g., a consecutive sequence of at least about 5, 10, 15, 20, 25, 30, 35, 40, 45, 50, 55, or 60 amino acids of the capsid subunit of a viral capsid protein, e.g., the HIV capsid protein. The amino acid and nucleotide sequences of the HIV-1 capsid protein are described in, e.g., Kuiken et al., (2008). "*HIV Sequence Compendium*", Los Alamos National Laboratory. In some embodiments, the anti-microbial polypeptide has at least about 75%, 80%, 85%, 90%, 95%, 100% sequence homology to the corresponding viral protein sequence. In other embodiments, the anti-microbial polypeptide comprises or consists of a synthetic peptide corresponding to a region, e.g., a consecutive sequence of at least about 5, 10, 15, 20, 25, 30, 35, 40, 45, 50, 55, or 60 amino acids of the binding domain of a capsid binding protein. In some embodiments, the anti-microbial polypeptide has at least about 75%, 80%, 85%, 90%, 95%, 100% sequence homology to the corresponding sequence of the capsid binding protein.

The anti-microbial polypeptides described herein may block protease dimerization and inhibit cleavage of viral proproteins (e.g., HIV Gag-pol processing) into functional proteins thereby preventing release of one or more enveloped viruses (e.g., HIV, HCV). For example, the anti-microbial polypeptide can comprise or consist of a synthetic peptide corresponding to a region, e.g., a consecutive sequence of at least about 5, 10, 15, 20, 25, 30, 35, 40, 45, 50, 55, or 60 amino acids of a viral protease, e.g., the HIV-1 protease. The amino acid and nucleotide sequences of the HIV-1 protease are described in, e.g., Kuiken et al., (2008). "*HIV Sequence Compendium*", Los Alamos National Laboratory. In some embodiments, the anti-microbial polypeptide has at least about 75%, 80%, 85%, 90%, 95%, 100% sequence homology to the corresponding viral protein sequence. In other embodiments, the anti-microbial polypeptide can comprise or consist of a synthetic peptide corresponding to a region, e.g., a consecutive sequence of at least about 5, 10, 15, 20, 25, 30, 35, 40, 45, 50, 55, or 60 amino acids of the binding domain of a protease binding protein. In some embodiments, the anti-microbial polypeptide has at least about 75%, 80%, 85%, 90%, 95%, 100% sequence homology to the corresponding sequence of the protease binding protein.

The anti-microbial polypeptides described herein can include a polypeptide corresponding to the inhibitory region of the endogenous human protein TRIM5-α or cyclophilin A (peptidylprolyl isomerase A). The sequences of human TRIM5-α and cyclophilin A are described, e.g., in Stremlau et al., *Nature*. 2004; 427(6977):848-53 and Takahashi et al., *Nature* 1989; 337 (6206), 473-475, respectively.

The anti-microbial polypeptides described herein can include an in vitro-evolved polypeptide directed against a viral pathogen, e.g., a polypeptide identified or selected by the method described in Example 7.

Modified Nucleic Acids.

This invention provides nucleic acids, including RNAs such as mRNAs that contain one or more modified nucleosides (termed "modified nucleic acids"), which have useful properties including the lack of a substantial induction of the innate immune response of a cell into which the mRNA is introduced. Because these modified nucleic acids enhance the efficiency of protein production, intracellular retention of nucleic acids, and viability of contacted cells, as well as possess reduced immunogenicity, these nucleic acids having these properties are termed "enhanced nucleic acids" herein.

The term "nucleic acid," in its broadest sense, includes any compound and/or substance that is or can be incorporated into an oligonucleotide chain. Exemplary nucleic acids for use in accordance with the present invention include, but are not limited to, one or more of DNA, RNA, hybrids thereof, RNAi-inducing agents, RNAi agents, siRNAs, shRNAs, miRNAs, antisense RNAs, ribozymes, catalytic DNA, RNAs that induce triple helix formation, aptamers, vectors, etc., described in detail herein.

Provided are modified nucleic acids containing a translatable region encoding an anti-microbial polypeptide (e.g., an anti-bacterial polypeptide), e.g., an anti-microbial polypeptide described herein, and one, two, or more than two different nucleoside modifications. In some embodiments, the modified nucleic acid exhibits reduced degradation in a cell into which the nucleic acid is introduced, relative to a corresponding unmodified nucleic acid. For example, the degradation rate of the nucleic acid is reduced by at least 10%, 20%, 30%, 40%, 50%, 60%, 70%, 80%, or 90%, compared to the degradation rate of the corresponding unmodified nucleic acid. Exemplary nucleic acids include ribonucleic acids (RNAs), deoxyribonucleic acids (DNAs), threose nucleic acids (TNAs), glycol nucleic acids (GNAs), peptide nucleic acids (PNAs), locked nucleic acids (LNAs) or a hybrid thereof. In preferred embodiments, the modified nucleic acid includes messenger RNAs (mRNAs). As described herein, the nucleic acids of the invention do not substantially induce an innate immune response of a cell into which the mRNA is introduced.

In some embodiments, modified nucleosides include pyridin-4-one ribonucleoside, 5-aza-uridine, 2-thio-5-aza-uridine, 2-thiouridine, 4-thio-pseudouridine, 2-thio-pseudouridine, 5-hydroxyuridine, 3-methyluridine, 5-carboxymethyluridine, 1-carboxymethyl-pseudouridine, 5-propynyluridine, 1-propynyl-pseudouridine, 5-taurinomethyluridine, 1-taurinomethyl-pseudouridine, 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-1-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxyuridine, 2-methoxy-4-thio-uridine, 4-methoxy-pseudouridine, and 4-methoxy-2-thio-pseudouridine.

In some embodiments, modified nucleosides include 5-aza-cytidine, pseudoisocytidine, 3-methyl-cytidine, N4-acetylcytidine, 5-formylcytidine, N4-methylcytidine, 5-hydroxymethylcytidine, 1-methyl-pseudoisocytidine, pyrrolo-cytidine, pyrrolo-pseudoisocytidine, 2-thio-cytidine, 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, and 4-methoxy-1-methyl-pseudoisocytidine.

In other embodiments, modified nucleosides include 2-aminopurine, 2,6-diaminopurine, 7-deaza-adenine, 7-deaza-8-aza-adenine, 7-deaza-2-aminopurine, 7-deaza-8-aza-2-aminopurine, 7-deaza-2,6-diaminopurine, 7-deaza-8-aza-2,6-diaminopurine, 1-methyladenosine, N6-methyladenosine, N6-isopentenyladenosine, N6-(cis-hydroxyisopentenyl)adenosine, 2-methylthio-N6-(cis-hydroxyisopentenyl) adenosine, N6-glycinylcarbamoyladenosine, N6-threonylcarbamoyladenosine, 2-methylthio-N6-threonyl carbamoyladenosine, N6,N6-dimethyladenosine, 7-methyladenine, 2-methylthio-adenine, and 2-methoxy-adenine.

In certain embodiments it is desirable to intracellularly degrade a modified nucleic acid introduced into the cell, for example if precise timing of protein production is desired. Thus, the invention provides a modified nucleic acid containing a degradation domain, which is capable of being acted on in a directed manner within a cell.

In other embodiments, modified nucleosides include inosine, 1-methyl-inosine, wyosine, wybutosine, 7-deaza-guanosine, 7-deaza-8-aza-guanosine, 6-thio-guanosine, 6-thio-7-deaza-guanosine, 6-thio-7-deaza-8-aza-guanosine, 7-methyl-guanosine, 6-thio-7-methyl-guanosine, 7-methyl-inosine, 6-methoxy-guanosine, 1-methylguanosine, N2-methylguanosine, N2,N2-dimethylguanosine, 8-oxo-guanosine, 7-methyl-8-oxo-guanosine, 1-methyl-6-thio-guanosine, N2-methyl-6-thio-guanosine, and N2,N2-dimethyl-6-thio-guanosine.

Other components of nucleic acid are optional, and are beneficial in some embodiments. For example, a 5' untranslated region (UTR) and/or a 3'UTR are provided, wherein either or both may independently contain one or more different nucleoside modifications. In such embodiments, nucleoside modifications may also be present in the translatable region. Also provided are nucleic acids containing a Kozak sequence.

Additionally, nucleic acids encoding anti-microbial polypeptides (e.g., anti-bacterial polypeptides), e.g., anti-microbial polypeptides described herein, and containing one or more intronic nucleotide sequences capable of being excised from the nucleic acid are provided herein.

Further, nucleic acids encoding anti-microbial polypeptides (e.g., anti-bacterial polypeptides), e.g., anti-microbial polypeptides described herein, and containing an internal ribosome entry site (IRES) are provided herein. An IRES may act as the sole ribosome binding site, or may serve as one of multiple ribosome binding sites of an mRNA. An mRNA containing more than one functional ribosome binding site may encode several peptides or polypeptides that are translated independently by the ribosomes ("multicistronic mRNA"). When nucleic acids are provided with an IRES, further optionally provided is a second translatable region. Examples of IRES sequences that can be used according to the invention include without limitation, those from picornaviruses (e.g., FMDV), pest viruses (CFFV), polio viruses (PV), encephalomyocarditis viruses (ECMV), foot-and-mouth disease viruses (FMDV), hepatitis C viruses (HCV), classical swine fever viruses (CSFV), murine leukemia virus (MLV), simian immune deficiency viruses (SIV) or cricket paralysis viruses (CrPV).

Prevention or Reduction of Innate Cellular Immune Response Activation Using Modified Nucleic Acids.

The term "innate immune response" includes a cellular response to exogenous single stranded nucleic acids, generally of viral or bacterial origin, which involves the induction of cytokine expression and release, particularly the interferons, and cell death. Protein synthesis is also reduced during the innate cellular immune response. While it is advantageous to eliminate the innate immune response in a cell, the invention provides modified mRNAs that substantially reduce the immune response, including interferon signaling, without entirely eliminating such a response. In some embodiments, the immune response is reduced by 10%, 20%, 30%, 40%, 50%, 60%, 70%, 80%, 90%, 95%, 99%, 99.9%, or greater than 99.9% as compared to the immune response induced by a corresponding unmodified nucleic acid. Such a reduction can be measured by expression or activity level of Type 1 interferons or the expression of interferon-regulated genes such as the toll-like receptors (e.g., TLR7 and TLR8). Reduction of innate immune response can also be measured by decreased cell death following one or more administrations of modified RNAs to a cell population; e.g., cell death is 10%, 25%, 50%, 75%, 85%, 90%, 95%, or over 95% less than the cell death frequency observed with a corresponding unmodified nucleic acid. Moreover, cell death may affect fewer than 50%, 40%, 30%, 20%, 10%, 5%, 1%, 0.1%, 0.01% or fewer than 0.01% of cells contacted with the modified nucleic acids.

The invention provides for the repeated introduction (e.g., transfection) of modified nucleic acids into a target cell population, e.g., in vitro, ex vivo, or in vivo. The step of contacting the cell population may be repeated one or more times (such as two, three, four, five or more than five times). In some embodiments, the step of contacting the cell population with the modified nucleic acids is repeated a number of times sufficient such that a predetermined efficiency of protein translation in the cell population is achieved. Given the reduced cytotoxicity of the target cell population provided by the nucleic acid modifications, such repeated transfections are achievable in a diverse array of cell types.

Polypeptide Variants.

Provided are nucleic acids that encode variant polypeptides, which have a certain identity with a reference polypeptide (e.g., an anti-microbial polypeptide (e.g., an anti-bacterial polypeptide), e.g., an anti-microbial polypeptide described herein) sequence. The term "identity" as known in the art, refers to a relationship between the sequences of two or more peptides, as determined by comparing the sequences. In the art, "identity" also means the degree of sequence relatedness between peptides, as determined by the number of matches between strings of two or more amino acid residues. "Identity" measures the percent of identical matches between the smaller of two or more sequences with gap alignments (if any) addressed by a particular mathematical model or computer program (i.e., "algorithms"). Identity of related peptides can be readily calculated by known methods. Such methods include, but are not limited to, those described in Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part 1, Griffin, A. M., and Griffin, H. G., eds., Humana Press, New Jersey, 1994; Sequence Analysis in Molecular Biology, von Heinje, G., Academic Press, 1987; Sequence Analysis Primer, Gribskov, M. and Devereux, J., eds., M. Stockton Press, New York, 1991; and Carillo et al., SIAM J. Applied Math. 48, 1073 (1988).

In some embodiments, the polypeptide variant has the same or a similar activity as the reference polypeptide. Alternatively, the variant has an altered activity (e.g., increased or decreased) relative to a reference polypeptide. Generally, variants of a particular polynucleotide or polypeptide of the invention will have at least about 40%, 45%, 50%, 55%, 60%, 65%, 70%, 75%, 80%, 85%, 90%, 91%, 92%, 93%, 94%, 95%, 96%, 97%, 98%, 99% or more sequence identity to that particular reference polynucleotide or polypeptide as determined by sequence alignment programs and parameters described herein and known to those skilled in the art.

As recognized by those skilled in the art, protein fragments, functional protein domains, and homologous proteins are also considered to be within the scope of this invention. For example, provided herein is any protein fragment of a reference protein (meaning a polypeptide sequence at least one amino acid residue shorter than a reference polypeptide sequence but otherwise identical) 5, 10, 15, 20, 25, 30, 35, 40, 45, 50, 55, 60, 70, 80, 90, 100, or greater than 100 amino acids in length In another example, any protein that includes a stretch of about 20, about 30, about 40, about 50, or about 100 amino acids which are about 40%, about 50%, about 60%, about 70%, about 80%, about 90%, about 95%, about 98%, or about 100% identical to any of the sequences described herein can be utilized in accordance with the invention. In certain embodiments, a protein sequence to be utilized in accordance with the invention includes 2, 3, 4, 5, 6, 7, 8, 9, 10, or more mutations as shown in any of the sequences provided or referenced herein.

Polynucleotide Libraries.

Also provided are polynucleotide libraries containing nucleoside modifications, wherein the polynucleotides individually contain a first nucleic acid sequence encoding a polypeptide, such as an anti-microbial polypeptide (e.g., an anti-bacterial polypeptide), e.g., an anti-microbial polypeptide described herein. Preferably, the polynucleotides are mRNA in a form suitable for direct introduction into a target cell host, which in turn synthesizes the encoded polypeptide.

In certain embodiments, multiple variants of a protein, each with different amino acid modification(s), are produced and tested to determine the best variant in terms of pharmacokinetics, stability, biocompatibility, and/or biological activity, or a biophysical property such as expression level. Such a library may contain 10, $10^2$, $10^3$, $10^4$, $10^5$, $10^6$, $10^7$, $10^8$, $10^9$, or over $10^9$ possible variants (including substitutions, deletions of one or more residues, and insertion of one or more residues).

Polypeptide-Nucleic Acid Complexes.

Proper protein translation involves the physical aggregation of a number of polypeptides and nucleic acids associated with the mRNA. Provided by the invention are complexes containing conjugates of protein and nucleic acids, containing a translatable mRNA encoding an anti-microbial polypeptide (e.g., an anti-bacterial polypeptide), e.g., an anti-microbial polypeptide described herein), and having one or more nucleoside modifications (e.g., at least two different nucleoside modifications) and one or more polypeptides bound to the mRNA. Generally, the proteins are provided in an amount effective to prevent or reduce an innate immune response of a cell into which the complex is introduced.

Targeting Moieties.

In embodiments of the invention, modified nucleic acids are provided to express a protein-binding partner or a receptor on the surface of the cell, which functions to target the cell to a specific tissue space or to interact with a specific moiety, either in vivo or in vitro. Suitable protein-binding partners include antibodies and functional fragments thereof, scaffold proteins, or peptides. Additionally, modified nucleic acids can be employed to direct the synthesis and extracellular localization of lipids, carbohydrates, or other biological moieties.

Untranslatable Modified Nucleic Acids; Vaccines.

As described herein, provided are mRNAs having sequences that are substantially not translatable. Such mRNA is effective as a vaccine when administered to a mammalian subject.

Also provided are modified nucleic acids that contain one or more noncoding regions. Such modified nucleic acids are generally not translated, but are capable of binding to and sequestering one or more translational machinery component such as a ribosomal protein or a transfer RNA (tRNA), thereby effectively reducing protein expression in the cell. The modified nucleic acid may contain a small nucleolar RNA (sno-RNA), micro RNA (miRNA), small interfering RNA (siRNA), or Piwi-interacting RNA (piRNA).

Additionally, certain modified nucleosides, or combinations thereof, when introduced into modified nucleic acids activate the innate immune response. Such activating modified nucleic acids, e.g., modified RNAs, are useful as adjuvants when combined with polypeptides (e.g., anti-microbial polypeptides) or other vaccines. In certain embodiments, the activated modified mRNAs contain a translatable region which encodes for a polypeptide (e.g., an anti-microbial polypeptide (e.g., an anti-microbial polypeptide described herein)) sequence useful as a vaccine, thus providing the ability to be a self-adjuvant.

Modified Nucleic Acid Synthesis.

Nucleic acids for use in accordance with the invention may be prepared according to any available technique including, but not limited to chemical synthesis, enzymatic synthesis, which is generally termed in vitro transcription, enzymatic or chemical cleavage of a longer precursor, etc. Methods of synthesizing RNAs are known in the art (see, e.g., Gait, M. J. (ed.) *Oligonucleotide synthesis: a practical approach*, Oxford (Oxfordshire), Washington, D.C.: IRL Press, 1984; and Herdewijn, P. (ed.) *Oligonucleotide synthesis: methods and applications*, Methods in Molecular Biology, v. 288 (Clifton, N.J.) Totowa, N.J.: Humana Press, 2005; both of which are incorporated herein by reference).

Modified nucleic acids need not be uniformly modified along the entire length of the molecule. Different nucleotide modifications and/or backbone structures may exist at various positions in the nucleic acid. One of ordinary skill in the art will appreciate that the nucleotide analogs or other modification(s) may be located at any position(s) of a nucleic acid such that the function of the nucleic acid is not substantially decreased. A modification may also be a 5' or 3' terminal modification. The nucleic acids may contain at a minimum one and at maximum 100% modified nucleotides, or any intervening percentage, such as at least 50% modified nucleotides, at least 80% modified nucleotides, or at least 90% modified nucleotides.

Generally, the length of a modified mRNA of the present invention is greater than 30 nucleotides in length. In another embodiment, the RNA molecule is greater than 35, 40, 45, 50, 60, 75, 100, 125, 150, 175, 200, 250, 300, 350, 400, 450, 500, 600, 700, 800, 900, 1000, 1100, 1200, 1300, 1400, 1500, 1800, 2000, 3000, 4000, 5000 nucleotides, or greater than 5000 nucleotides.

Uses of Modified Nucleic Acids.

Therapeutic Agents.

The modified nucleic acids described herein can be used as therapeutic agents to treat or prevent microbial infections and/or diseases, disorders, or conditions associated with microbial infections. Provided herein are compositions (e.g., pharmaceutical compositions), formulations, methods, kits, dressings (e.g., wound dressings), bandages (e.g., adhesive bandages), and reagents for treatment or prevention of diseases, disorders, or conditions, e.g., diseases, disorders, or conditions associated with microbial infections (e.g., bacterial infections), in humans and other animals (e.g., mammals). The active therapeutic agents of the invention include modified nucleic acids, cells containing modified nucleic acids or polypeptides translated from the modified nucleic acids, polypeptides translated from modified nucleic acids, and cells contacted with cells containing modified nucleic acids or polypeptides translated from the modified nucleic acids.

Provided are methods of inducing translation of a recombinant polypeptide (e.g., an anti-microbial polypeptide described herein) in a cell population using the modified nucleic acids described herein. Such translation can be in vivo, ex vivo, in culture, or in vitro. The cell population is contacted with an effective amount of a composition containing a nucleic acid that has at least one nucleoside modification, and a translatable region encoding the recombinant polypeptide. The population is contacted under conditions such that the nucleic acid is localized into one or more cells of the cell population and the recombinant polypeptide is translated in the cell from the nucleic acid.

An effective amount of the composition is provided based, at least in part, on the target tissue, target cell type, means of administration, physical characteristics of the nucleic acid (e.g., size, and extent of modified nucleosides), and other determinants. In general, an effective amount of the composition provides efficient protein production in the cell, preferably more efficient than a composition containing a corresponding unmodified nucleic acid. Increased efficiency may be demonstrated by increased cell transfection (i.e., the percentage of cells transfected with the nucleic acid), increased protein translation from the nucleic acid, decreased nucleic acid degradation (as demonstrated, e.g., by increased duration of protein translation from a modified nucleic acid), or reduced innate immune response of the host cell.

Aspects of the disclosures are directed to methods of inducing in vivo translation of a recombinant polypeptide (e.g., an anti-microbial polypeptide described herein) in a human or animal (e.g., mammalian) subject in need thereof. Therein, an effective amount of a composition containing a nucleic acid that has at least one nucleoside modification and a translatable region encoding the recombinant polypeptide (e.g., an anti-microbial polypeptide described herein) is administered to the subject using the delivery methods described herein. The nucleic acid is provided in an amount and under other conditions such that the nucleic acid is localized into a cell of the subject and the recombinant polypeptide is translated in the cell from the nucleic acid. The cell in which the nucleic acid is localized, or the tissue in which the cell is present, may be targeted with one or more than one rounds of nucleic acid administration.

Other aspects of the disclosures relate to transplantation of cells containing modified nucleic acids to a human or animal (e.g., mammalian) subject. Administration of cells to human or animal (e.g., mammalian) subjects is known to those of ordinary skill in the art, such as local implantation (e.g., topical or subcutaneous administration), organ delivery or systemic injection (e.g., intravenous injection or inhalation), as is the formulation of cells in pharmaceutically acceptable carrier. Compositions containing modified nucleic acids are formulated for administration intramuscularly, transarterially, intraocularly, vaginally, rectally, intraperitoneally, intravenously, intranasally, subcutaneously, endoscopically, transdermally, or intrathecally. In some embodiments, the composition is formulated for extended release.

The subject to whom the therapeutic agent is administered suffers from or is at risk of developing a disease, disorder, or deleterious condition. Provided are methods of identifying, diagnosing, and classifying subjects on these bases, which may include clinical diagnosis, biomarker levels, genome-wide association studies (GWAS), and other methods known in the art.

In certain embodiments, nucleic acids encoding an anti-microbial polypeptide (e.g., an anti-bacterial polypeptide), e.g., an anti-microbial polypeptide described herein, are administered to subjects in need of anti-microbial polypeptide (e.g., an anti-bacterial polypeptide) administration.

In certain embodiments, the administered modified nucleic acid directs production of one or more recombinant polypeptides that provide a functional activity which is substantially absent in the cell in which the recombinant polypeptide is translated. For example, the missing functional activity may be enzymatic, structural, or gene regulatory in nature. In related embodiments, the administered modified nucleic acid directs production of one or more recombinant polypeptides that increases (e.g., synergistically) a functional activity which is present but substantially deficient in the cell in which the recombinant polypeptide is translated.

In other embodiments, the administered modified nucleic acid directs production of one or more recombinant polypeptides that replace a polypeptide (or multiple polypeptides) that is substantially absent in the cell in which the recombinant polypeptide is translated. Such absence may be due to genetic mutation of the encoding gene or regulatory pathway thereof. In some embodiments, the recombinant polypeptide increases the level of an endogenous protein in the cell to a desirable level; such an increase may bring the level of the endogenous protein from a subnormal level to a normal level, or from a normal level to a super-normal level.

Alternatively, the recombinant polypeptide functions to antagonize the activity of an endogenous protein present in, on the surface of, or secreted from the cell. Usually, the activity of the endogenous protein is deleterious to the subject, for example, due to mutation of the endogenous protein resulting in altered activity or localization. Additionally, the recombinant polypeptide antagonizes, directly or indirectly, the activity of a biological moiety present in, on the surface of, or secreted from the cell. Examples of antagonized biological moieties include lipids (e.g., cholesterol), a lipoprotein (e.g., low density lipoprotein), a nucleic acid, a carbohydrate, a protein toxin such as shiga and tetanus toxins, or a small molecule toxin such as botulinum, cholera, and diphtheria toxins. Additionally, the antagonized biological molecule may be an endogenous protein that exhibits an undesirable activity, such as a cytotoxic or cytostatic activity.

The recombinant proteins described herein are engineered for localization within the cell, potentially within a specific compartment such as the nucleus, or are engineered for secretion from the cell or translocation to the plasma membrane of the cell.

As described herein, a useful feature of the modified nucleic acids of the invention is the capacity to reduce the innate immune response of a cell to an exogenous nucleic acid. Provided are methods for performing the titration, reduction or elimination of the immune response in a cell or a population of cells. In some embodiments, the cell is contacted with a first composition that contains a first dose of a first exogenous nucleic acid including a translatable region and at least one nucleoside modification, and the level of the innate immune response of the cell to the first exogenous nucleic acid is determined. Subsequently, the cell is contacted with a second composition, which includes a second dose of the first exogenous nucleic acid, the second dose containing a lesser amount of the first exogenous nucleic acid as compared to the first dose. Alternatively, the cell is contacted with a first dose of a second exogenous nucleic acid. The second exogenous nucleic acid may contain one or more modified nucleosides, which may be the same or different from the first exogenous nucleic acid or, alternatively, the second exogenous nucleic acid may not contain modified nucleosides. The steps of contacting the cell with the first composition and/or the second composition may be repeated one or more times. Additionally, efficiency of protein production (e.g., protein translation) in the cell is optionally determined, and the cell may be re-transfected with the first and/or second composition repeatedly until a target protein production efficiency is achieved.

Topical Delivery Applied to the Skin.

The skin is a desirable target site for nucleic acid delivery. It is readily accessible, and gene expression may be restricted not only to the skin, potentially avoiding nonspecific toxicity, but also to specific layers and cell types within the skin. The site of cutaneous expression of the delivered nucleic acid will depend on the route of nucleic acid delivery. Three routes are commonly considered to deliver nucleic acids to the skin: (i) topical application (e.g. for local/regional treatment); (ii) intradermal injection (e.g. for local/regional treatment); and (iii) systemic delivery (e.g., for treatment of dermatologic diseases that affect both cutaneous and extracutaneous regions). Nucleic acids can be delivered to the skin by several different approaches. Most have been shown to work for DNA, such as, topical application of non-cationic liposome—DNA complex, cationic liposome—DNA complex, particle-mediated (gene gun), puncture-mediated gene transfections, and viral delivery approaches. After gene delivery, gene products have been detected in a number of skin cell types, including but not limited to, basal keratinocytes, sebaceous gland cells, dermal fibroblasts and dermal macrophages.

In certain embodiments, dressing compositions comprising a modified nucleic acid encoding for an anti-microbial polypeptide (e.g., an anti-bacterial polypeptide), e.g., an anti-microbial polypeptide described herein, precursor or a partially or fully processed form are provided herein.

In certain embodiments, the composition described herein is formulated for administration via a bandage (e.g., adhesive bandage).

The modified nucleic acids encoding for an anti-microbial polypeptide (e.g., an anti-bacterial polypeptide), e.g., an anti-microbial polypeptide described herein, precursor or a partially or fully processed form described herein may be intermixed with the dressing compositions or may be applied separately, e.g. by soaking or spraying.

Targeting Moieties.

In embodiments of the disclosure, modified nucleic acids are provided to express a protein-binding partner or a receptor on the surface of the cell, which functions to target the cell to a specific tissue space or to interact with a specific moiety, either in vivo or in vitro. Suitable protein-binding partners include antibodies and functional fragments thereof, scaffold proteins, or peptides. Additionally, modified nucleic acids can be employed to direct the synthesis and extracellular localization of lipids, carbohydrates, or other biological moieties.

Methods of Treating Diseases and Conditions.

Provided are methods for treating or preventing a microbial infection (e.g., a bacterial infection) and/or a disease, disorder, or condition associated with a microbial infection (e.g., a bacterial infection), and/or a symptom thereof, by providing an anti-microbial (e.g., anti-bacterial) activity. Because of the rapid initiation of protein production following introduction of modified mRNAs, as compared to viral DNA vectors, the compounds of the present invention are particularly advantageous in treating acute or chronic diseases such as microbial infections and sepsis. Moreover, the lack of transcriptional regulation of the modified mRNAs of the invention is advantageous in that accurate titration of protein production is achievable. In some embodiments, modified mRNAs and their encoded polypeptides in accordance with the present invention may be used for therapeutic purposes.

In some embodiments, modified mRNAs and their encoded polypeptides in accordance with the present disclosure may be used for treatment of microbial infections and/or any of a variety of diseases, disorders, and/or conditions associated with microbial infections. Microbial infections can include, but not limited to, bacterial infections, viral infections, fungal infections, and protozoan infections.

In one embodiment, modified mRNAs and their encoded polypeptides in accordance with the present disclosure may be useful in the treatment of inflammatory disorders coincident with or resulting from infection.

Exemplary diseases, disorders, or conditions associated with bacterial infections include, but not limited to one or more of the following: abscesses, actinomycosis, acute prostatitis, aeromonas hydrophila, annual ryegrass toxicity, anthrax, bacillary peliosis, bacteremia, bacterial gastroenteritis, bacterial meningitis, bacterial pneumonia, bacterial vaginosis, bacterium-related cutaneous conditions, bartonellosis, BCG-oma, botryomycosis, botulism, Brazilian purpuric fever, Brodie abscess, brucellosis, Buruli ulcer, campylobacteriosis, caries, Carrion's disease, cat scratch disease, cellulitis, *chlamydia* infection, cholera, chronic bacterial prostatitis, chronic recurrent multifocal osteomyelitis, clostridial necrotizing enteritis, combined periodontic-endodontic lesions, contagious bovine pleuropneumonia, diphtheria, diphtheritic stomatitis, ehrlichiosis, erysipelas, piglottitis, erysipelas, Fitz-Hugh-Curtis syndrome, fleaborne spotted fever, foot rot (infectious pododermatitis), Garre's sclerosing osteomyelitis, Gonorrhea, Granuloma inguinale, human granulocytic anaplasmosis, human monocytotropic ehrlichiosis, hundred days' cough, impetigo, late congenital syphilitic oculopathy, legionellosis, Lemierre's syndrome, leprosy (Hansen's Disease), leptospirosis, listeriosis, Lyme disease, lymphadenitis, melioidosis, meningococcal disease, meningococcal septicaemia, methicillin-resistant *Staphylococcus aureus* (MRSA) infection, *mycobacterium avium-intracellulare* (MAI), mycoplasma pneumonia, necrotizing fasciitis, nocardiosis, noma (cancrum oris or gangrenous stomatitis), omphalitis, orbital cellulitis, osteomyelitis, overwhelming post-splenectomy infection (OPSI), ovine brucellosis, pasteurellosis, periorbital cellulitis, pertussis (whooping cough), plague, pneumococcal pneumonia, Pott disease, proctitis, *pseudomonas* infection, psittacosis, pyaemia, pyomyositis, Q fever, relapsing fever (typhinia), rheumatic fever, Rocky Mountain spotted fever (RMSF), rickettsiosis, salmonellosis, scarlet fever, sepsis, *serratia* infection, shigellosis, southern tick-associated rash illness, staphylococcal scalded skin syndrome, streptococcal pharyngitis, swimming pool granuloma, swine brucellosis, syphilis, syphilitic aortitis, tetanus, toxic shock syndrome (TSS), trachoma, trench fever, tropical ulcer, tuberculosis, tularemia, typhoid fever, typhus, urogenital tuberculosis, urinary tract infections, vancomycin-resistant *Staphylococcus aureus* infection, Waterhouse-Friderichsen syndrome, *pseudotuberculosis* (*Yersinia*) disease, and yersiniosis. Other diseases, disorders, and/or conditions associated with bacterial infections can include, for example, Alzheimer's disease, anorexia nervosa, asthma, atherosclerosis, attention deficit hyperactivity disorder, autism, autoimmune diseases, bipolar disorder, cancer (e.g., colorectal cancer, gallbladder cancer, lung cancer, pancreatic cancer, and stomach cancer), chronic fatigue syndrome, chronic obstructive pulmonary disease, Crohn's disease, coronary heart disease, dementia, depression, Guillain-Barré syndrome, metabolic syndrome, multiple sclerosis, myocardial infarction, obesity, obsessive-compulsive disorder, panic disorder, psoriasis, rheumatoid arthritis, sarcoidosis, schizophrenia, stroke, thromboangiitis obliterans (Buerger's disease), and Tourette syndrome.

The bacterium described herein can be a Gram-positive bacterium or a Gram-negative bacterium. Exemplary bacterial pathogens include, but not limited to, *Acinetobacter baumannii, Bacillus anthracis, Bacillus subtilis, Bordetella pertussis, Borrelia burgdorferi, Brucella abortus, Brucella canis, Brucella melitensis, Brucella suis, Campylobacter jejuni, Chlamydia pneumoniae, Chlamydia trachomatis, Chlamydophila psittaci, Clostridium botulinum, Clostridium difficile, Clostridium perfringens, Clostridium tetani,* coagulase Negative *Staphylococcus, Corynebacterium diphtheria, Enterococcus faecalis, Enterococcus faecium, Escherichia coli,* enterotoxigenic *Escherichia coli* (ETEC), enteropathogenic *E. coli, E. coli* O157:H7, *Enterobacter* sp., *Francisella tularensis, Haemophilus influenzae, Helicobacter pylori, Klebsiella pneumoniae, Legionella pneumophila, Leptospira interrogans, Listeria monocytogenes, Moraxella catarralis, Mycobacterium leprae, Mycobacterium tuberculosis, Mycoplasma pneumoniae, Neisseria gonorrhoeae, Neisseria meningitides, Preteus mirabilis, Proteus* sps., *Pseudomonas aeruginosa, Rickettsia rickettsii, Salmonella typhi, Salmonella typhimurium, Serratia marcesens, Shigella flexneri, Shigella sonnei, Staphylococcus aureus, Staphylococcus epidermidis, Staphylococcus saprophyticus, Streptococcus agalactiae, Streptococcus mutans, Streptococcus pneumoniae, Streptococcus pyogenes, Treponema pallidum, Vibrio cholerae,* and *Yersinia pestis.* Bacterial pathogens may also include bacteria that cause resistant bacterial infections, for example, clindamycin-resistant *Clostridium difficile,* fluoroquinolon-resistant *Clostridium difficile,* methicillin-resistant *Staphylococcus aureus* (MRSA), multidrug-resistant *Enterococcus faecalis,* multidrug-resistant *Enterococcus faecium,* multidrug-resistance *Pseudomonas aeruginosa,* multidrug-resistant *Acinetobacter baumannii,* and vancomycin-resistant *Staphylococcus aureus* (VRSA).

Exemplary diseases, disorders, or conditions associated with viral infections include, but not limited to, acute febrile pharyngitis, pharyngoconjunctival fever, epidemic keratoconjunctivitis, infantile gastroenteritis, Coxsackie infections, infectious mononucleosis, Burkitt lymphoma, acute hepatitis, chronic hepatitis, hepatic cirrhosis, hepatocellular carcinoma, primary HSV-1 infection (e.g., gingivostomatitis in children, tonsillitis and pharyngitis in adults, keratoconjunctivitis), latent HSV-1 infection (e.g., herpes labialis and cold sores), primary HSV-2 infection, latent HSV-2 infection, aseptic meningitis, infectious mononucleosis, Cytomegalic inclusion disease, Kaposi sarcoma, multicentric Castleman disease, primary effusion lymphoma, AIDS, influenza, Reye syndrome, measles, postinfectious encephalomyelitis, Mumps, hyperplastic epithelial lesions (e.g., common, flat, plantar and anogenital warts, laryngeal papillomas, epidermodysplasia verruciformis), cervical carcinoma, squamous cell carcinomas, croup, pneumonia, bronchiolitis, common cold, Poliomyelitis, Rabies, bronchiolitis, pneumonia, influenza-like syndrome, severe bronchiolitis with pneumonia, German measles, congenital rubella, Varicella, and herpes zoster.

Exemplary viral pathogens include, but not limited to, adenovirus, coxsackievirus, dengue virus, encephalitis virus, Epstein-Barr virus, hepatitis A virus, hepatitis B virus, hepatitis C virus, herpes simplex virus type 1, herpes simplex virus type 2, cytomegalovirus, human herpesvirus type 8, human immunodeficiency virus, influenza virus, measles virus, mumps virus, human papillomavirus, parainfluenza virus, poliovirus, rabies virus, respiratory syncytial virus, rubella virus, varicella-zoster virus, West Nile virus, and yellow fever virus. Viral pathogens may also include viruses that cause resistant viral infections.

Exemplary diseases, disorders, or conditions associated with fungal infections include, but not limited to, aspergilloses, blastomycosis, candidasis, coccidioidomycosis, cryptococcosis, histoplasmosis, mycetomas, paracoccidioidomycosis, and tinea pedis. Furthermore, persons with immunodeficiencies are particularly susceptible to disease by fungal genera such as *Aspergillus, Candida, Cryptoccocus, Histoplasma,* and *Pneumocystis.* Other fungi can attack eyes, nails, hair, and especially skin, the so-called dermatophytic fungi and keratinophilic fungi, and cause a variety of conditions, of which ringworms such as athlete's foot are common. Fungal spores are also a major cause of allergies, and a wide range of fungi from different taxonomic groups can evoke allergic reactions in some people.

Exemplary fungal pathogens include, but not limited to, Ascomycota (e.g., *Fusarium oxysporum, Pneumocystis jirovecii, Aspergillus* spp., *Coccidioides immitis/posadasii, Candida albicans*), Basidiomycota (e.g., *Filobasidiella neoformans, Trichosporon*), Microsporidia (e.g., *Encephalitozoon cuniculi, Enterocytozoon bieneusi*), and Mucoromycotina (e.g., *Mucor circinelloides, Rhizopus oryzae, Lichtheimia corymbifera*).

Exemplary diseases, disorders, or conditions associated with protozoal infections include, but not limited to, amoebiasis, giardiasis, trichomoniasis, African Sleeping Sickness, American Sleeping Sickness, leishmaniasis (Kala-Azar), balantidiasis, toxoplasmosis, malaria, *acanthamoeba keratitis*, and babesiosis.

Exemplary protozoal pathogens include, but not limited to, *Entamoeba histolytica, Giardia lambila, Trichomonas vaginalis, Trypanosoma brucei, T. cruzi, Leishmania donovani, Balantidium coli, Toxoplasma gondii, Plasmodium* spp., and *Babesia microti*.

Exemplary diseases, disorders, or conditions associated with parasitic infections include, but not limited to, *acanthamoeba keratitis*, amoebiasis, ascariasis, babesiosis, balantidiasis, baylisascariasis, chagas disease, clonorchiasis, *cochliomyia*, cryptosporidiosis, diphyllobothriasis, dracunculiasis, echinococcosis, elephantiasis, enterobiasis, fascioliasis, fasciolopsiasis, filariasis, giardiasis, gnathostomiasis, hymenolepiasis, isosporiasis, katayama fever, leishmaniasis, lyme disease, malaria, metagonimiasis, myiasis, onchocerciasis, pediculosis, scabies, schistosomiasis, sleeping sickness, strongyloidiasis, taeniasis, toxocariasis, toxoplasmosis, trichinosis, and trichuriasis.

Exemplary parasitic pathogens include, but not limited to, Acanthamoeba, Anisakis, *Ascaris lumbricoides*, botfly, *Balantidium coli*, bedbug, *Cestoda*, chiggers, *Cochliomyia hominivorax, Entamoeba histolytica, Fasciola hepatica, Giardia lamblia*, hookworm, *Leishmania, Linguatula serrata*, liver fluke, *Loa loa, Paragonimus*, pinworm, *Plasmodium falciparum, Schistosoma, Strongyloides stercoralis*, mite, tapeworm, *Toxoplasma gondii, Trypanosoma*, whipworm, *Wuchereria bancrofti*.

Exemplary diseases, disorders, or conditions associated with prion infections include, but not limited to Creutzfeldt-Jakob disease (CJD), iatrogenic Creutzfeldt-Jakob disease (iCJD), variant Creutzfeldt-Jakob disease (vCJD), familial Creutzfeldt-Jakob disease (fCJD), sporadic Creutzfeldt-Jakob disease (sCJD), Gerstmann-Sträussler-Scheinker syndrome (GSS), fatal familial insomnia (FFI), Kuru, Scrapie, bovine spongiform encephalopathy (BSE), mad cow disease, transmissible mink encephalopathy (TME), chronic wasting disease (CWD), feline spongiform encephalopathy (FSE), exotic ungulate encephalopathy (EUE), and spongiform encephalopathy.

Provided herein, are methods to prevent infection and/or sepsis in a subject at risk of developing infection and/or sepsis, the method comprising administering to a subject in need of such prevention a composition comprising a modified nucleic acid precursor encoding an anti-microbial polypeptide (e.g., an anti-bacterial polypeptide), e.g., an anti-microbial polypeptide described herein, or a partially or fully processed form thereof in an amount sufficient to prevent infection and/or sepsis. In certain embodiments, the subject at risk of developing infection and/or sepsis is a cancer patient. In certain embodiments, the cancer patient has undergone a conditioning regimen. In some embodiments, the conditioning regiment comprises chemotherapy, radiation therapy, or both.

Further provided herein, are methods to treat infection and/or sepsis in a subject, the method comprising administering to a subject in need of such treatment a composition comprising a modified nucleic acid precursor encoding an anti-microbial polypeptide (e.g., an anti-bacterial polypeptide), e.g., an anti-microbial polypeptide described herein, or a partially or fully processed form thereof in an amount sufficient to treat an infection and/or sepsis. In certain embodiments, the subject in need of treatment is a cancer patient. In certain embodiments, the cancer patient has undergone a conditioning regimen. In some embodiments, the conditioning regiment comprises chemotherapy, radiation therapy, or both.

In one embodiment, the modified mRNAs of the present invention may be administered in conjunction with one or more antibiotics. These include, but are not limited to Aknilox, Ambisome, Amoxycillin, Ampicillin, Augmentin, Avelox, Azithromycin, Bactroban, Betadine, Betnovate, Blephamide, Cefaclor, Cefadroxil, Cefdinir, Cefepime, Cefix, Cefixime, Cefoxitin, Cefpodoxime, Cefprozil, Cefuroxime, Cefzil, Cephalexin, Cephazolin, Ceptaz, Chloramphenicol, Chlorhexidine, Chloromycetin, Chlorsig, Ciprofloxacin, Clarithromycin, Clindagel, Clindamycin, Clindatech, Cloxacillin, Colistin, Co-trimoxazole, Demeclocycline, Diclocil, Dicloxacillin, Doxycycline, Duricef, Erythromycin, Flamazine, Floxin, Framycetin, Fucidin, Furadantin, Fusidic, Gatifloxacin, Gemifloxacin, Gemifloxacin, Ilosone, Iodine, Levaquin, Levofloxacin, Lomefloxacin, Maxaquin, Mefoxin, Meronem, Minocycline, Moxifloxacin, Myambutol, Mycostatin, Neosporin, Netromycin, Nitrofurantoin, Norfloxacin, Norilet, Ofloxacin, Omnicef, Ospamox, Oxytetracycline, Paraxin, Penicillin, Pneumovax, Polyfax, Povidone, Rifadin, Rifampin, Rifaximin, Rifinah, Rimactane, Rocephin, Roxithromycin, Seromycin, Soframycin, Sparfloxacin, Staphlex, Targocid, Tetracycline, Tetradox, Tetralysal, tobramycin, Tobramycin, Trecator, Tygacil, Vancocin, Velosef, Vibramycin, Xifaxan, Zagam, Zitrotek, Zoderm, Zymar, and Zyvox.

In certain embodiments, the subject exhibits acute or chronic microbial infections (e.g., bacterial infections). In certain embodiments, the subject has received or is receiving a therapy. In certain embodiments, the therapy is radiotherapy, chemotherapy, steroids, ultraviolet radiation, or a combination thereof. In certain embodiments, the patient suffers from a microvascular disorder. In some embodiments, the microvascular disorder is diabetes. In certain embodiments, the patient has a wound. In some embodiments, the wound is an ulcer. In a specific embodiment, the wound is a diabetic foot ulcer. In certain embodiments, the subject has one or more burn wounds. In certain embodiments, the administration is local or systemic. In certain embodiments, the administration is subcutaneous. In certain embodiments, the administration is intravenous. In certain embodiments, the administration is oral. In certain embodiments, the administration is topical. In certain embodiments, the administration is by inhalation. In certain embodiments, the administration is rectal. In certain embodiments, the administration is vaginal.

Combination Therapy

Provided are methods for treating or preventing a microbial infection (e.g., a bacterial infection) and/or a disease, disorder, or condition associated with a microbial infection (e.g., a bacterial infection), or a symptom thereof, in a subject, by administering a modified nucleic acid encoding an anti-microbial polypeptide (e.g., an anti-bacterial polypeptide), e.g., an anti-microbial polypeptide described herein in combination with an anti-microbial agent (e.g., an anti-bacterial agent), e.g., an anti-microbial polypeptide or a small molecule anti-microbial compound described herein. The anti-microbial agents include, but not limited to, anti-bacterial agents, anti-viral agents, anti-fungal agents, anti-protozoal agents, anti-parasitic agents, and anti-prion agents.

The agents can be administered simultaneously, for example in a combined unit dose (e.g., providing simultaneous delivery of both agents). Alternatively, the agents can be administered at a specified time interval, for example, an interval of minutes, hours, days or weeks. Generally, the agents are concurrently bioavailable, e.g., detectable, in the subject. In some embodiments, the agents are administered essentially simultaneously, for example two unit dosages administered at the same time, or a combined unit dosage of the two agents. In other embodiments, the agents are delivered in separate unit dosages. The agents can be administered in any order, or as one or more preparations that includes two or more agents. In a preferred embodiment, at least one administration of one of the agents, e.g., the first agent, is made within minutes, one, two, three, or four hours, or even within one or two days of the other agent, e.g., the second agent. In some embodiments, combinations can achieve synergistic results, e.g., greater than additive results, e.g., at least 25, 50, 75, 100, 200, 300, 400, or 500% greater than additive results.

Exemplary anti-bacterial agents include, but not limited to, aminoglycosides (e.g., amikacin (AMIKIN®), gentamicin (GARAMYCIN®), kanamycin (KANTREX®), neomycin (MYCIFRADIN®), netilmicin (NETROMYCIN®), tobramycin (NEBCIN®), Paromomycin (HUMATIN®), ansamycins (e.g., geldanamycin, herbimycin), carbacephem (e.g., loracarbef (LORABID®), Carbapenems (e.g., ertapenem (INVANZ®), doripenem (DORIBAX®), imipenem/cilastatin (PRIMAXIN®), meropenem (MERREM®), cephalosporins (first generation) (e.g., cefadroxil (DURICEF®), cefazolin (ANCEF®), cefalotin or cefalothin (KEFLIN®), cefalexin (KEFLEX®), cephalosporins (second generation) (e.g., cefaclor (CECLOR®), cefamandole (MANDOL®), cefoxitin (MEFOXIN®), cefprozil (CEFZIL®), cefuroxime (CEFTIN®, ZINNAT®), cephalosporins (third generation) (e.g., cefixime (SUPRAX®), cefdinir (OMNICEF®, CEFDIEL®), cefditoren (SPECTRACEF®), cefoperazone (CEFOBID®), cefotaxime (CLAFORAN®), cefpodoxime (VANTIN®), ceftazidime (FORTAZ®), ceftibuten (CEDAX®), ceftizoxime (CEFIZOX®), ceftriaxone (ROCEPHIN®), cephalosporins (fourth generation) (e.g., cefepime (MAXIPIME®), cephalosporins (fifth generation) (e.g., ceftobiprole (ZEFTERA®), glycopeptides (e.g., teicoplanin (TARGOCID®), vancomycin (VANCOCIN®), telavancin (VIBATIV®), lincosamides (e.g., clindamycin (CLEOCIN®), lincomycin (LINCOCIN®), lipopeptide (e.g., daptomycin (CUBICIN®), macrolides (e.g., azithromycin (ZITHROMAX®, SUMAMED®, ZITROCIN®), clarithromycin (BIAXIN®), dirithromycin (DYNABAC®), erythromycin (ERYTHOCIN®, ERYTHROPED®), roxithromycin, troleandomycin (TAO®), telithromycin (KETEK®), spectinomycin (TROBICIN®), monobactams (e.g., aztreonam (AZACTAM®), nitrofurans (e.g., furazolidone (FUROXONE®), nitrofurantoin (MACRODANTIN®, MACROBID®), penicillins (e.g., amoxicillin (NOVAMOX®, AMOXIL®), ampicillin (PRINCIPEN®), azlocillin, carbenicillin (GEOCILLIN®), cloxacillin (TEGOPEN®), dicloxacillin (DYNAPEN®), flucloxacillin (FLOXAPEN®), mezlocillin (MEZLIN®), methicillin (STAPHCILLIN®), nafcillin (UNIPEN®), oxacillin (PROSTAPHLIN®), penicillin G (PENTIDS®), penicillin V (PEN-VEE-K®), piperacillin (PIPRACIL®), temocillin (NEGABAN®), ticarcillin (TICAR®), penicillin combinations (e.g., amoxicillin/clavulanate (AUGMENTIN®), ampicillin/sulbactam (UNASYN®), piperacillin/tazobactam (ZOSYN®), ticarcillin/clavulanate (TIMENTIN®), polypeptides (e.g., bacitracin, colistin (COLYMYCIN-S®), polymyxin B, quinolones (e.g., ciprofloxacin (CIPRO®, CIPROXIN®, CIPROBAY®), enoxacin (PENETREX®), gatifloxacin (TEQUIN®), levofloxacin (LEVAQUIN®), lomefloxacin (MAXAQUIN®), moxifloxacin (AVELOX®), nalidixic acid (NEGGRAM®), norfloxacin (NOROXIN®), ofloxacin (FLOXIN®, OCUFLOX®), trovafloxacin (TROVAN®), grepafloxacin (RAXAR®), sparfloxacin (ZAGAM®), temafloxacin (OMNIFLOX®), sulfonamides (e.g., mafenide (SULFAMYLON®), sulfonamidochrysoidine (PRONTOSIL®), sulfacetamide (SULAMYD®, BLEPH-10®), sulfadiazine (MICRO-SULFON®), silver sulfadiazine (SILVADENE®), sulfamethizole (THIOSULFIL FORTE®), sulfamethoxazole (GANTANOL®), sulfanilimide, sulfasalazine (AZULFIDINE®), sulfisoxazole (GANTRISIN®), trimethoprim (PROLOPRIM®, TRIMPEX®), trimethoprim-sulfamethoxazole (co-trimoxazole) (TMP-SMX) (BACTRIM®, SEPTRA®), tetracyclines (e.g., demeclocycline (DECLOMYCIN®), doxycycline (VIBRAMYCIN®), minocycline (MINOCIN®), oxytetracycline (TERRAMYCIN®), tetracycline (SUMYCIN®, ACHROMYCIN® V, STECLIN®), drugs against mycobacteria (e.g., clofazimine (LAMPRENE®), dapsone (AVLOSULFON®), capreomycin (CAPASTAT®), cycloserine (SEROMYCIN®), ethambutol (MYAMBUTOL®), ethionamide (TRECATOR®), isoniazid (I.N.H.®), pyrazinamide (ALDINAMIDE®), rifampin (RIFADIN®, RIMACTANE®), rifabutin (MYCOBUTIN®), rifapentine (PRIFTIN®), streptomycin), and others (e.g., arsphenamine (SALVARSAN®), chloramphenicol (CHLOROMYCETIN®), fosfomycin (MONUROL®), fusidic acid (FUCIDIN®), linezolid (ZYVOX®), metronidazole (FLAGYL®), mupirocin (BACTROBAN®), platensimycin, quinupristin/dalfopristin (SYNERCID®), rifaximin (XIFAXAN®), thiamphenicol, tigecycline (TIGACYL®), tinidazole (TINDAMAX®, FASIGYN®).

Exemplary anti-viral agents include, but not limited to, abacavir (ZIAGEN®), abacavir/lamivudine/zidovudine (Trizivir®), aciclovir or acyclovir (CYCLOVIR®, HERPEX®, ACIVIR®, ACIVIRAX®, ZOVIRAX®, ZOVIR®), adefovir (Preveon®, Hepsera®), amantadine (SYMMETREL®), amprenavir (AGENERASE®), ampligen, arbidol, atazanavir (REYATAZ®), boceprevir, cidofovir, darunavir (PREZISTA®), delavirdine (RESCRIPTOR®), didanosine (VIDEX®), docosanol (ABREVA®), edoxudine, efavirenz (SUSTIVA®, STOCRIN®), emtricitabine (EMTRIVA®), emtricitabine/tenofovir/efavirenz (ATRIPLA®), enfuvirtide (FUZEON®), entecavir (BARACLUDE®, ENTAVIR®), famciclovir (FAMVIR®), fomivirsen (VITRAVENE®), fosamprenavir (LEXIVA®, TELZIR®), foscarnet (FOSCAVIR®), fosfonet, ganciclovir (CYTOVENE®, CYMEVENE®, VITRASERT®), GS 9137 (ELVITEGRAVIR®), imiquimod (ALDARA®, ZYCLARA®, BESELNA®), indinavir (CRIXIVAN®), inosine, inosine pranobex (IMUNOVIR®), interferon type I, interferon type II, interferon type III, kutapressin (NEXAVIR®), lamivudine (ZEFFIX®, HEPTOVIR®, EPIVIR®), lamivudine/zidovudine (COMBIVIR®), lopinavir, loviride, maraviroc (SELZENTRY®, CELSENTRI®), methisazone, MK-2048, moroxydine, nelfinavir (VIRACEPT®), nevirapine (VIRAMUNE®), oseltamivir (TAMIFLU®), peginterferon alfa-2a (PEGASYS®), penciclovir (DENAVIR®), peramivir, pleconaril, podophyllotoxin (CONDYLOX®), raltegravir (ISENTRESS®), ribavirin (COPEGUs®, REBETOL®, RIBASPHERE®, VILONA® AND VIRAZOLE®), rimantadine (FLUMADINE®), ritonavir (NORVIR®), pyramidine, saquinavir (INVIRASE®, FORTOVASE®), stavudine, tea tree oil (melaleuca oil), tenofovir (VIREAD®), tenofovir/emtricitabine (TRUVADA®), tipranavir (APTIVUS®), trifluridine (VIROPTIC®), tromantadine (VIRUMERZ®), valaciclovir (VALTREX®), valganciclovir (VALCYTE®), vicriviroc, vidarabine, viramidine, zalcitabine, zanamivir (RELENZA®), and zidovudine (azidothymidine (AZT), RETROVIR®, RETROVIS®).

Exemplary anti-fungal agents include, but not limited to, polyene antifungals (e.g., natamycin, rimocidin, filipin, nystatin, amphotericin B, candicin, hamycin), imidazole antifungals (e.g., miconazole (MICATIN®, DAKTARIN®), ketoconazole (NIZORAL®, FUNGORAL®, SEBIZOLE®), clotrimazole (LOTRIMIN®, LOTRIMIN® AF, CANESTEN®), econazole, omoconazole, bifonazole, butoconazole, fenticonazole, isoconazole, oxiconazole, sertaconazole (ERTACZO®), sulconazole, tioconazole), triazole antifungals (e.g., albaconazole fluconazole, itraconazole, isavuconazole, ravuconazole, posaconazole, voriconazole, terconazole), thiazole antifungals (e.g., abafungin), allylamines (e.g., terbinafine (LAMISIL®), naftifine (NAFTIN®), butenafine (LOTRIMIN® Ultra)), echinocandins (e.g., anidulafungin, caspofungin, micafungin), and others (e.g., polygodial, benzoic acid, ciclopirox, tolnaftate (TINACTIN®, DESENEX®, AFTATE®), undecylenic acid, flucytosine or 5-fluorocytosine, griseofulvin, haloprogin, sodium bicarbonate, allicin).

Exemplary anti-protozoal agents include, but not limited to, eflornithine, furazolidone (FUROXONE®, DEPENDAL-M®), melarsoprol, metronidazole (FLAGYL®), ornidazole, paromomycin sulfate (HUMATIN®), pentamidine, pyrimethamine (DARAPRIM®), and tinidazole (TINDAMAX®, FASIGYN®).

Exemplary anti-parasitic agents include, but not limited to, antinematodes (e.g., mebendazole, pyrantel pamoate, thiabendazole, diethylcarbamazine, ivermectin), anticestodes (e.g., niclosamide, praziquantel, albendazole), antitrematodes (e.g., praziquantel), antiamoebics (e.g., rifampin, amphotericin B), and antiprotozoals (e.g., melarsoprol, eflornithine, metronidazole, tinidazole).

Exemplary anti-prion agents include, but not limited to, flupirtine, pentosan polysuphate, quinacrine, and tetracyclic compounds.

Targeting of Pathogenic Organisms; Purification of Biological Materials.

Provided herein are methods for targeting pathogenic microorganisms, such as bacteria, yeast, protozoa, parasites, prions and the like, using modified mRNAs that encode cytostatic or cytotoxic polypeptides, e.g., anti-microbial polypeptides described herein. Preferably the mRNA introduced into the target pathogenic organism contains modified nucleosides or other nucleic acid sequence modifications that the mRNA is translated exclusively, or preferentially, in the target pathogenic organism, to reduce possible off-target effects of the therapeutic. Such methods are useful for removing pathogenic organisms from biological material, including blood, semen, eggs, and transplant materials including embryos, tissues, and organs.

Targeting of Diseased Cells.

Provided herein are methods for targeting pathogenic or diseased cells, particularly cells that are infected with one or more microorganisms (e.g., bacteria) or cancer cells, using modified mRNAs that encode cytostatic and/or cytotoxic polypeptides, e.g., anti-microbial polypeptides described herein. Preferably the mRNA introduced into the target pathogenic cell contains modified nucleosides or other nucleic acid sequence modifications that the mRNA is translated exclusively, or preferentially, in the target pathogenic cell, to reduce possible off-target effects of the therapeutic. Alternatively, the invention provides targeting moieties that are capable of targeting the modified mRNAs to preferentially bind to and enter the target pathogenic cell.

Methods of Protein Production.

The methods provided herein are useful for enhancing protein (e.g., an anti-microbial polypeptide described herein) product yield in a cell culture process. In a cell culture containing a plurality of host cells, introduction of the modified mRNAs described herein results in increased protein production efficiency relative to a corresponding unmodified nucleic acid. Such increased protein production efficiency can be demonstrated, e.g., by showing increased cell transfection, increased protein translation from the nucleic acid, decreased nucleic acid degradation, and/or reduced innate immune response of the host cell. Protein production can be measured by ELISA, and protein activity can be measured by various functional assays known in the art. The protein production may be generated in a continuous or a fed-batch mammalian process.

Additionally, it is useful to optimize the expression of a specific polypeptide (e.g., an anti-microbial described herein) in a cell line or collection of cell lines of potential interest, particularly an engineered protein such as a protein variant of a reference protein having a known activity. In one embodiment, provided is a method of optimizing expression of an engineered protein in a target cell, by providing a plurality of target cell types, and independently contacting with each of the plurality of target cell types a modified mRNA encoding an engineered polypeptide. Additionally, culture conditions may be altered to increase protein production efficiency. Subsequently, the presence and/or level of the engineered polypeptide in the plurality of target cell types is detected and/or quantitated, allowing for the optimization of an engineered polypeptide's expression by selection of an efficient target cell and cell culture conditions relating thereto. Such methods are particularly useful when the engineered polypeptide contains one or more post-translational modifications or has substantial tertiary structure, situations which often complicate efficient protein production.

Modulation of Biological Pathways.

The rapid translation of modified mRNAs introduced into cells provides a desirable mechanism of modulating target biological pathways, e.g., biological pathways associated with microbial infections (e.g., bacterial infections) and/or diseases, disorders or conditions associated with microbial infections (e.g., bacterial infections). Such modulation includes antagonism or agonism of a given pathway. In one embodiment, a method is provided for antagonizing a biological pathway in a cell by contacting the cell with an effective amount of a composition comprising a modified nucleic acid encoding a recombinant polypeptide, under conditions such that the nucleic acid is localized into the cell and the recombinant polypeptide is capable of being translated in the cell from the nucleic acid, wherein the recombinant polypeptide inhibits the activity of a polypeptide functional in the biological pathway.

Alternatively, provided are methods of agonizing a biological pathway in a cell by contacting the cell with an effective amount of a modified nucleic acid encoding a recombinant polypeptide under conditions such that the nucleic acid is localized into the cell and the recombinant polypeptide is capable of being translated in the cell from the nucleic acid, and the recombinant polypeptide induces the activity of a polypeptide functional in the biological pathway. Exemplary agonized biological pathways include pathways that modulate anti-bacterial activity. Such agonization is reversible or, alternatively, irreversible.

Methods of Cellular Nucleic Acid Delivery.

Methods of the present invention enhance nucleic acid delivery into a cell population, in vivo, ex vivo, or in culture. For example, a cell culture containing a plurality of host cells (e.g., eukaryotic cells such as yeast or mammalian cells) is contacted with a composition that contains an enhanced nucleic acid having at least one nucleoside modification and, optionally, a translatable region encoding an anti-microbial polypeptide (e.g., an anti-bacterial polypeptide), e.g., an antimicrobial polypeptide described herein. The composition also generally contains a transfection reagent or other compound that increases the efficiency of enhanced nucleic acid uptake into the host cells. The enhanced nucleic acid exhibits enhanced retention in the cell population, relative to a corresponding unmodified nucleic acid. The retention of the enhanced nucleic acid is greater than the retention of the unmodified nucleic acid. In some embodiments, it is at least about 50%, 75%, 90%, 95%, 100%, 150%, 200%, or more than 200% greater than the retention of the unmodified nucleic acid. Such retention advantage may be achieved by one round of transfection with the enhanced nucleic acid, or may be obtained following repeated rounds of transfection.

In some embodiments, the enhanced nucleic acid is delivered to a target cell population with one or more additional nucleic acids. Such delivery may be at the same time, or the enhanced nucleic acid is delivered prior to delivery of the one or more additional nucleic acids. The additional one or more nucleic acids may be modified nucleic acids or unmodified nucleic acids. It is understood that the initial presence of the enhanced nucleic acids does not substantially induce an innate immune response of the cell population and, moreover, that the innate immune response will not be activated by the later presence of the unmodified nucleic acids. In this regard, the enhanced nucleic acid may not itself contain a translatable region, if the protein desired to be present in the target cell population is translated from the unmodified nucleic acids.

Pharmaceutical Compositions

The present invention provides enhanced nucleic acids (e.g., nucleic acids described herein), and complexes containing enhanced nucleic acids associated with other deliverable moieties. Thus, the present invention provides pharmaceutical compositions comprising one or more enhanced nucleic acids, or one or more such complexes, and one or more pharmaceutically acceptable excipients. Pharmaceutical compositions may optionally comprise one or more additional therapeutically active substances. In some embodiments, compositions are administered to humans. For the purposes of the present disclosure, the phrase "active ingredient" generally refers to an enhanced nucleic acid to be delivered as described herein.

Although the descriptions of pharmaceutical compositions provided herein are principally directed to pharmaceutical compositions which are suitable for administration to humans, it will be understood by the skilled artisan that such compositions are generally suitable for administration to animals of all sorts. Modification of pharmaceutical compositions suitable for administration to humans in order to render the compositions suitable for administration to various animals is well understood, and the ordinarily skilled veterinary pharmacologist can design and/or perform such modification with merely ordinary, if any, experimentation. Subjects to which administration of the pharmaceutical compositions is contemplated include, but are not limited to, humans and/or other animals (e.g., primates, mammals), including commercially relevant mammals such as cattle, pigs, horses, sheep, cats, dogs, mice, and/or rats; and/or birds, including commercially relevant birds such as chickens, ducks, geese, and/or turkeys.

Formulations of the pharmaceutical compositions described herein may be prepared by any method known or hereafter developed in the art of pharmacology. In general, such preparatory methods include the step of bringing the active ingredient into association with an excipient and/or one or more other accessory ingredients, and then, if necessary and/or desirable, shaping and/or packaging the product into a desired single- or multi-dose unit.

A pharmaceutical composition in accordance with the invention may be prepared, packaged, and/or sold in bulk, as a single unit dose, and/or as a plurality of single unit doses. As used herein, a "unit dose" is discrete amount of the pharmaceutical composition comprising a predetermined amount of the active ingredient. The amount of the active ingredient is generally equal to the dosage of the active ingredient which would be administered to a subject and/or a convenient fraction of such a dosage such as, for example, one-half or one-third of such a dosage.

Relative amounts of the active ingredient, the pharmaceutically acceptable excipient, and/or any additional ingredients in a pharmaceutical composition in accordance with the invention will vary, depending upon the identity, size, and/or condition of the subject treated and further depending upon the route by which the composition is to be administered. By way of example, the composition may comprise between 0.1% and 100% (w/w) active ingredient.

Pharmaceutical formulations may additionally comprise a pharmaceutically acceptable excipient, which, as used herein, includes any and all solvents, dispersion media, diluents, or other liquid vehicles, dispersion or suspension aids, surface active agents, isotonic agents, thickening or emulsifying agents, preservatives, solid binders, lubricants and the like, as suited to the particular dosage form desired. Remington's *The Science and Practice of Pharmacy*, 21$^{st}$ Edition, A. R. Gennaro (Lippincott, Williams & Wilkins, Baltimore, Md., 2006; incorporated herein by reference) discloses various excipients used in formulating pharmaceutical compositions and known techniques for the preparation thereof. Except insofar as any conventional excipient medium is incompatible with a substance or its derivatives, such as by producing any undesirable biological effect or otherwise interacting in a deleterious manner with any other component(s) of the pharmaceutical composition, its use is contemplated to be within the scope of this invention.

In some embodiments, a pharmaceutically acceptable excipient is at least 95%, at least 96%, at least 97%, at least 98%, at least 99%, or 100% pure. In some embodiments, an excipient is approved for use in humans and for veterinary use. In some embodiments, an excipient is approved by United States Food and Drug Administration. In some embodiments, an excipient is pharmaceutical grade. In some embodiments, an excipient meets the standards of the United States Pharmacopoeia (USP), the European Pharmacopoeia (EP), the British Pharmacopoeia, and/or the International Pharmacopoeia.

Pharmaceutically acceptable excipients used in the manufacture of pharmaceutical compositions include, but are not limited to, inert diluents, dispersing and/or granulating agents, surface active agents and/or emulsifiers, disintegrating agents, binding agents, preservatives, buffering agents, lubricating agents, and/or oils. Such excipients may optionally be included in pharmaceutical formulations. Excipients such as cocoa butter and suppository waxes, coloring agents, coating agents, sweetening, flavoring, and/or perfuming agents can be present in the composition, according to the judgment of the formulator.

Exemplary diluents include, but are not limited to, calcium carbonate, sodium carbonate, calcium phosphate, dicalcium phosphate, calcium sulfate, calcium hydrogen phosphate, sodium phosphate lactose, sucrose, cellulose, microcrystalline cellulose, kaolin, mannitol, sorbitol, inositol, sodium chloride, dry starch, cornstarch, powdered sugar, etc., and/or combinations thereof.

Exemplary granulating and/or dispersing agents include, but are not limited to, potato starch, corn starch, tapioca starch, sodium starch glycolate, clays, alginic acid, guar gum, citrus pulp, agar, bentonite, cellulose and wood products, natural sponge, cation-exchange resins, calcium carbonate, silicates, sodium carbonate, cross-linked poly(vinylpyrrolidone) (crospovidone), sodium carboxymethyl starch (sodium starch glycolate), carboxymethyl cellulose, cross-linked sodium carboxymethyl cellulose (croscarmellose), methylcellulose, pregelatinized starch (starch 1500), microcrystalline starch, water insoluble starch, calcium carboxymethyl cellulose, magnesium aluminum silicate (Veegum), sodium lauryl sulfate, quaternary ammonium compounds, etc., and/or combinations thereof.

Exemplary surface active agents and/or emulsifiers include, but are not limited to, natural emulsifiers (e.g. *acacia*, agar, alginic acid, sodium alginate, tragacanth, chondrux, cholesterol, xanthan, pectin, gelatin, egg yolk, casein, wool fat, cholesterol, wax, and lecithin), colloidal clays (e.g. bentonite [aluminum silicate] and Veegum® [magnesium aluminum silicate]), long chain amino acid derivatives, high molecular weight alcohols (e.g. stearyl alcohol, cetyl alcohol, oleyl alcohol, triacetin monostearate, ethylene glycol distearate, glyceryl monostearate, and propylene glycol monostearate, polyvinyl alcohol), carbomers (e.g. carboxy polymethylene, polyacrylic acid, acrylic acid polymer, and carboxyvinyl polymer), carrageenan, cellulosic derivatives (e.g. carboxymethylcellulose sodium, powdered cellulose, hydroxymethyl cellulose, hydroxypropyl cellulose, hydroxypropyl methylcellulose, methylcellulose), sorbitan fatty acid esters (e.g. polyoxyethylene sorbitan monolaurate [Tween®20], polyoxyethylene sorbitan [Tween®60], polyoxyethylene sorbitan monooleate [Tween®80], sorbitan monopalmitate [Span®40], sorbitan monostearate [Span®60], sorbitan tristearate [Span 65], glyceryl monooleate, sorbitan monooleate [Span®80]), polyoxyethylene esters (e.g. polyoxyethylene monostearate [Myrj®45], polyoxyethylene hydrogenated castor oil, polyethoxylated castor oil, polyoxymethylene stearate, and Solutol®), sucrose fatty acid esters, polyethylene glycol fatty acid esters (e.g. Cremophor®), polyoxyethylene ethers, (e.g. polyoxyethylene lauryl ether [Brij® 30]), poly(vinyl-pyrrolidone), diethylene glycol monolaurate, triethanolamine oleate, sodium oleate, potassium oleate, ethyl oleate, oleic acid, ethyl laurate, sodium lauryl sulfate, Pluronic®F 68, Poloxamer®188, cetrimonium bromide, cetylpyridinium chloride, benzalkonium chloride, docusate sodium, etc. and/or combinations thereof.

Exemplary binding agents include, but are not limited to, starch (e.g. cornstarch and starch paste); gelatin; sugars (e.g. sucrose, glucose, dextrose, dextrin, molasses, lactose, lactitol, mannitol,); natural and synthetic gums (e.g. *acacia*, sodium alginate, extract of Irish moss, panwar gum, ghatti gum, mucilage of isapol husks, carboxymethylcellulose, methylcellulose, ethylcellulose, hydroxyethylcellulose, hydroxypropyl cellulose, hydroxypropyl methylcellulose, microcrystalline cellulose, cellulose acetate, poly(vinyl-pyrrolidone), magnesium aluminum silicate (Veegum®), and larch arabogalactan); alginates; polyethylene oxide; polyethylene glycol; inorganic calcium salts; silicic acid; polymethacrylates; waxes; water; alcohol; etc.; and combinations thereof.

Exemplary preservatives may include, but are not limited to, antioxidants, chelating agents, antimicrobial preservatives, antifungal preservatives, alcohol preservatives, acidic preservatives, and/or other preservatives. Exemplary antioxidants include, but are not limited to, alpha tocopherol, ascorbic acid, acorbyl palmitate, butylated hydroxyanisole, butylated hydroxytoluene, monothioglycerol, potassium metabisulfite, propionic acid, propyl gallate, sodium ascorbate, sodium bisulfite, sodium metabisulfite, and/or sodium sulfite. Exemplary chelating agents include ethylenediaminetetraacetic acid (EDTA), citric acid monohydrate, disodium edetate, dipotassium edetate, edetic acid, fumaric acid, malic acid, phosphoric acid, sodium edetate, tartaric acid, and/or trisodium edetate. Exemplary antimicrobial preservatives include, but are not limited to, benzalkonium chloride, benzethonium chloride, benzyl alcohol, bronopol, cetrimide, cetylpyridinium chloride, chlorhexidine, chlorobutanol, chlorocresol, chloroxylenol, cresol, ethyl alcohol, glycerin, hexetidine, imidurea, phenol, phenoxyethanol, phenylethyl alcohol, phenylmercuric nitrate, propylene glycol, and/or thimerosal. Exemplary antifungal preservatives include, but are not limited to, butyl paraben, methyl paraben, ethyl paraben, propyl paraben, benzoic acid, hydroxybenzoic acid, potassium benzoate, potassium sorbate, sodium benzoate, sodium propionate, and/or sorbic acid. Exemplary alcohol preservatives include, but are not limited to, ethanol, polyethylene glycol, phenol, phenolic compounds, bisphenol, chlorobutanol, hydroxybenzoate, and/or phenylethyl alcohol. Exemplary acidic preservatives include, but are not limited to, vitamin A, vitamin C, vitamin E, beta-carotene, citric acid, acetic acid, dehydroacetic acid, ascorbic acid, sorbic acid, and/or phytic acid. Other preservatives include, but are not limited to, tocopherol, tocopherol acetate, deteroxime mesylate, cetrimide, butylated hydroxyanisol (BHA), butylated hydroxytoluened (BHT), ethylenediamine, sodium lauryl sulfate (SLS), sodium lauryl ether sulfate (SLES), sodium bisulfite, sodium metabisulfite, potassium sulfite, potassium metabisulfite, Glydant Plus®, Phenonip®, methylparaben, Germall® 115, Germaben®II, Neolone™, Kathon™, and/or Euxyl®.

Exemplary buffering agents include, but are not limited to, citrate buffer solutions, acetate buffer solutions, phosphate buffer solutions, ammonium chloride, calcium carbonate, calcium chloride, calcium citrate, calcium glubionate, calcium gluceptate, calcium gluconate, D-gluconic acid, calcium glycerophosphate, calcium lactate, propanoic acid, calcium levulinate, pentanoic acid, dibasic calcium phosphate, phosphoric acid, tribasic calcium phosphate, calcium hydroxide phosphate, potassium acetate, potassium chloride, potassium gluconate, potassium mixtures, dibasic potassium phosphate, monobasic potassium phosphate, potassium phosphate mixtures, sodium acetate, sodium bicarbonate, sodium chloride, sodium citrate, sodium lactate, dibasic sodium phosphate, monobasic sodium phosphate, sodium phosphate mixtures, tromethamine, magnesium hydroxide, aluminum hydroxide, alginic acid, pyrogen-free water, isotonic saline, Ringer's solution, ethyl alcohol, etc., and/or combinations thereof.

Exemplary lubricating agents include, but are not limited to, magnesium stearate, calcium stearate, stearic acid, silica, talc, malt, glyceryl behanate, hydrogenated vegetable oils, polyethylene glycol, sodium benzoate, sodium acetate, sodium chloride, leucine, magnesium lauryl sulfate, sodium lauryl sulfate, etc., and combinations thereof.

Exemplary oils include, but are not limited to, almond, apricot kernel, avocado, babassu, bergamot, black current seed, borage, cade, camomile, canola, caraway, carnauba, castor, cinnamon, cocoa butter, coconut, cod liver, coffee, corn, cotton seed, emu, *eucalyptus*, evening primrose, fish, flaxseed, geraniol, gourd, grape seed, hazel nut, hyssop, isopropyl myristate, jojoba, kukui nut, lavandin, lavender, lemon, *litsea cubeba*, macadamia nut, mallow, mango seed, meadowfoam seed, mink, nutmeg, olive, orange, orange roughy, palm, palm kernel, peach kernel, peanut, poppy seed, pumpkin seed, rapeseed, rice bran, rosemary, safflower, sandalwood, sasquana, savoury, sea buckthorn, sesame, shea butter, silicone, soybean, sunflower, tea tree, thistle, tsubaki, vetiver, walnut, and wheat germ oils. Exemplary oils include, but are not limited to, butyl stearate, caprylic triglyceride, capric triglyceride, cyclomethicone, diethyl sebacate, dimethicone 360, isopropyl myristate, mineral oil, octyldodecanol, oleyl alcohol, silicone oil, and/or combinations thereof.

Liquid dosage forms for oral and parenteral administration include, but are not limited to, pharmaceutically acceptable emulsions, microemulsions, solutions, suspensions, syrups, and/or elixirs. In addition to active ingredients, liquid dosage forms may comprise inert diluents commonly used in the art such as, for example, water or other solvents, solubilizing agents and emulsifiers such as ethyl alcohol, isopropyl alcohol, ethyl carbonate, ethyl acetate, benzyl alcohol, benzyl benzoate, propylene glycol, 1,3-butylene glycol, dimethylformamide, oils (in particular, cottonseed, groundnut, corn, germ, olive, castor, and sesame oils), glycerol, tetrahydrofurfuryl alcohol, polyethylene glycols and fatty acid esters of sorbitan, and mixtures thereof. Besides inert diluents, oral compositions can include adjuvants such as wetting agents, emulsifying and suspending agents, sweetening, flavoring, and/or perfuming agents. In certain embodiments for parenteral administration, compositions are mixed with solubilizing agents such as Cremophor®, alcohols, oils, modified oils, glycols, polysorbates, cyclodextrins, polymers, and/or combinations thereof.

Injectable preparations, for example, sterile injectable aqueous or oleaginous suspensions may be formulated according to the known art using suitable dispersing agents, wetting agents, and/or suspending agents. Sterile injectable preparations may be sterile injectable solutions, suspensions, and/or emulsions in nontoxic parenterally acceptable diluents and/or solvents, for example, as a solution in 1,3-butanediol. Among the acceptable vehicles and solvents that may be employed are water, Ringer's solution, U.S.P., and isotonic sodium chloride solution. Sterile, fixed oils are conventionally employed as a solvent or suspending medium. For this purpose any bland fixed oil can be employed including synthetic mono- or diglycerides. Fatty acids such as oleic acid can be used in the preparation of injectables.

Injectable formulations can be sterilized, for example, by filtration through a bacterial-retaining filter, and/or by incorporating sterilizing agents in the form of sterile solid compositions which can be dissolved or dispersed in sterile water or other sterile injectable medium prior to use.

In order to prolong the effect of an active ingredient, it is often desirable to slow the absorption of the active ingredient from subcutaneous or intramuscular injection. This may be accomplished by the use of a liquid suspension of crystalline or amorphous material with poor water solubility. The rate of absorption of the drug then depends upon its rate of dissolution which, in turn, may depend upon crystal size and crystalline form. Alternatively, delayed absorption of a parenterally administered drug form is accomplished by dissolving or suspending the drug in an oil vehicle. Injectable depot forms are made by forming microencapsule matrices of the drug in biodegradable polymers such as polylactide-polyglycolide. Depending upon the ratio of drug to polymer and the nature of the particular polymer employed, the rate of drug release can be controlled. Examples of other biodegradable polymers include poly (orthoesters) and poly(anhydrides). Depot injectable formulations are prepared by entrapping the drug in liposomes or microemulsions which are compatible with body tissues.

Compositions for rectal or vaginal administration are typically suppositories which can be prepared by mixing compositions with suitable non-irritating excipients such as cocoa butter, polyethylene glycol or a suppository wax which are solid at ambient temperature but liquid at body temperature and therefore melt in the rectum or vaginal cavity and release the active ingredient. Solid dosage forms for oral administration include capsules, tablets, pills, powders, and granules. In such solid dosage forms, an active ingredient is mixed with at least one inert, pharmaceutically acceptable excipient such as sodium citrate or dicalcium phosphate and/or fillers or extenders (e.g. starches, lactose, sucrose, glucose, mannitol, and silicic acid), binders (e.g. carboxymethylcellulose, alginates, gelatin, polyvinylpyrrolidinone, sucrose, and *acacia*), humectants (e.g. glycerol), disintegrating agents (e.g. agar, calcium carbonate, potato or tapioca starch, alginic acid, certain silicates, and sodium carbonate), solution retarding agents (e.g. paraffin), absorption accelerators (e.g. quaternary ammonium compounds), wetting agents (e.g. cetyl alcohol and glycerol monostearate), absorbents (e.g. kaolin and bentonite clay), and lubricants (e.g. talc, calcium stearate, magnesium stearate, solid polyethylene glycols, sodium lauryl sulfate), and mixtures thereof. In the case of capsules, tablets and pills, the dosage form may comprise buffering agents.

Solid compositions of a similar type may be employed as fillers in soft and hard-filled gelatin capsules using such excipients as lactose or milk sugar as well as high molecular weight polyethylene glycols and the like. Solid dosage forms of tablets, dragees, capsules, pills, and granules can be prepared with coatings and shells such as enteric coatings and other coatings well known in the pharmaceutical formulating art. They may optionally comprise opacifying agents and can be of a composition that they release the active ingredient(s) only, or preferentially, in a certain part of the intestinal tract, optionally, in a delayed manner. Examples of embedding compositions which can be used include polymeric substances and waxes. Solid compositions of a similar type may be employed as fillers in soft and hard-filled gelatin capsules using such excipients as lactose or milk sugar as well as high molecular weight polyethylene glycols and the like.

Dosage forms for topical and/or transdermal administration of a composition may include ointments, pastes, creams, lotions, gels, powders, solutions, sprays, inhalants and/or patches. Generally, an active ingredient is admixed under sterile conditions with a pharmaceutically acceptable excipient and/or any needed preservatives and/or buffers as may be required. Additionally, the present invention contemplates the use of transdermal patches, which often have the added advantage of providing controlled delivery of a compound to the body. Such dosage forms may be prepared, for example, by dissolving and/or dispensing the compound in the proper medium. Alternatively or additionally, rate may be controlled by either providing a rate controlling membrane and/or by dispersing the compound in a polymer matrix and/or gel.

Suitable devices for use in delivering intradermal pharmaceutical compositions described herein include short needle devices such as those described in U.S. Pat. Nos. 4,886,499; 5,190,521; 5,328,483; 5,527,288; 4,270,537; 5,015,235; 5,141,496; and 5,417,662. Intradermal compositions may be administered by devices which limit the effective penetration length of a needle into the skin, such as those described in PCT publication WO 99/34850 and functional equivalents thereof. Jet injection devices which deliver liquid compositions to the dermis via a liquid jet injector and/or via a needle which pierces the stratum corneum and produces a jet which reaches the dermis are suitable. Jet injection devices are described, for example, in U.S. Pat. Nos. 5,480,381; 5,599,302; 5,334,144; 5,993,412; 5,649,912; 5,569,189; 5,704,911; 5,383,851; 5,893,397; 5,466,220; 5,339,163; 5,312,335; 5,503,627; 5,064,413; 5,520,639; 4,596,556; 4,790,824; 4,941,880; 4,940,460; and PCT publications WO 97/37705 and WO 97/13537. Ballistic powder/particle delivery devices which use compressed gas to accelerate vaccine in powder form through the outer layers of the skin to the dermis are suitable. Alternatively or additionally, conventional syringes may be used in the classical mantoux method of intradermal administration.

Formulations suitable for topical administration include, but are not limited to, liquid and/or semi liquid preparations such as liniments, lotions, oil in water and/or water in oil emulsions such as creams, ointments and/or pastes, and/or solutions and/or suspensions. Topically-administrable formulations may, for example, comprise from about 1% to about 10% (w/w) active ingredient, although the concentration of active ingredient may be as high as the solubility limit of the active ingredient in the solvent. Formulations for topical administration may further comprise one or more of the additional ingredients described herein.

A pharmaceutical composition may be prepared, packaged, and/or sold in a formulation suitable for pulmonary administration via the buccal cavity. Such a formulation may comprise dry particles which comprise the active ingredient and which have a diameter in the range from about 0.5 nm to about 7 nm or from about 1 nm to about 6 nm. Such compositions are suitably in the form of dry powders for administration using a device comprising a dry powder reservoir to which a stream of propellant may be directed to disperse the powder and/or using a self propelling solvent/powder dispensing container such as a device comprising the active ingredient dissolved and/or suspended in a low-boiling propellant in a sealed container. Such powders comprise particles wherein at least 98% of the particles by weight have a diameter greater than 0.5 nm and at least 95% of the particles by number have a diameter less than 7 nm. Alternatively, at least 95% of the particles by weight have a diameter greater than 1 nm and at least 90% of the particles by number have a diameter less than 6 nm. Dry powder compositions may include a solid fine powder diluent such as sugar and are conveniently provided in a unit dose form.

Low boiling propellants generally include liquid propellants having a boiling point of below 65° F. at atmospheric pressure. Generally the propellant may constitute 50% to 99.9% (w/w) of the composition, and active ingredient may constitute 0.1% to 20% (w/w) of the composition. A propellant may further comprise additional ingredients such as a liquid non-ionic and/or solid anionic surfactant and/or a solid diluent (which may have a particle size of the same order as particles comprising the active ingredient).

Pharmaceutical compositions formulated for pulmonary delivery may provide an active ingredient in the form of droplets of a solution and/or suspension. Such formulations may be prepared, packaged, and/or sold as aqueous and/or dilute alcoholic solutions and/or suspensions, optionally sterile, comprising active ingredient, and may conveniently be administered using any nebulization and/or atomization device. Such formulations may further comprise one or more additional ingredients including, but not limited to, a flavoring agent such as saccharin sodium, a volatile oil, a buffering agent, a surface active agent, and/or a preservative such as methylhydroxybenzoate. Droplets provided by this route of administration may have an average diameter in the range from about 0.1 nm to about 200 nm.

Formulations described herein as being useful for pulmonary delivery are useful for intranasal delivery of a pharmaceutical composition. Another formulation suitable for intranasal administration is a coarse powder comprising the active ingredient and having an average particle from about 0.2 μm to 500 μm. Such a formulation is administered in the manner in which snuff is taken, i.e. by rapid inhalation through the nasal passage from a container of the powder held close to the nose.

Formulations suitable for nasal administration may, for example, comprise from about as little as 0.1% (w/w) and as much as 100% (w/w) of active ingredient, and may comprise one or more of the additional ingredients described herein. A pharmaceutical composition may be prepared, packaged, and/or sold in a formulation suitable for buccal administration. Such formulations may, for example, be in the form of tablets and/or lozenges made using conventional methods, and may have, for example, 0.1% to 20% (w/w) active ingredient, the balance comprising an orally dissolvable and/or degradable composition and, optionally, one or more of the additional ingredients described herein. Alternately, formulations suitable for buccal administration may comprise a powder and/or an aerosolized and/or atomized solution and/or suspension comprising active ingredient. Such powdered, aerosolized, and/or aerosolized formulations, when dispersed, may have an average particle and/or droplet size in the range from about 0.1 nm to about 200 nm, and may further comprise one or more of any additional ingredients described herein.

A pharmaceutical composition may be prepared, packaged, and/or sold in a formulation suitable for ophthalmic administration. Such formulations may, for example, be in the form of eye drops including, for example, a 0.1/1.0% (w/w) solution and/or suspension of the active ingredient in an aqueous or oily liquid excipient. Such drops may further comprise buffering agents, salts, and/or one or more other of any additional ingredients described herein. Other opthalmically-administrable formulations which are useful include those which comprise the active ingredient in microcrystalline form and/or in a liposomal preparation. Ear drops and/or eye drops are contemplated as being within the scope of this invention.

General considerations in the formulation and/or manufacture of pharmaceutical agents may be found, for example, in *Remington: The Science and Practice of Pharmacy* 21$^{st}$ ed., Lippincott Williams & Wilkins, 2005 (incorporated herein by reference).

The present invention provides methods comprising administering modified mRNAs and their encoded proteins or complexes in accordance with the invention to a subject in need thereof. Nucleic acids, proteins or complexes, or pharmaceutical, imaging, diagnostic, or prophylactic compositions thereof, may be administered to a subject using any amount and any route of administration effective for preventing, treating, diagnosing, or imaging a disease, disorder, and/or condition (e.g., a disease, disorder, and/or condition relating to microbial infections). The exact amount required will vary from subject to subject, depending on the species, age, and general condition of the subject, the severity of the disease, the particular composition, its mode of administration, its mode of activity, and the like. Compositions in accordance with the invention are typically formulated in dosage unit form for ease of administration and uniformity of dosage. It will be understood, however, that the total daily usage of the compositions of the present invention will be decided by the attending physician within the scope of sound medical judgment. The specific therapeutically effective, prophylactially effective, or appropriate imaging dose level for any particular patient will depend upon a variety of factors including the disorder being treated and the severity of the disorder; the activity of the specific compound employed; the specific composition employed; the age, body weight, general health, sex and diet of the patient; the time of administration, route of administration, and rate of excretion of the specific compound employed; the duration of the treatment; drugs used in combination or coincidental with the specific compound employed; and like factors well known in the medical arts.

Devices may also be used in conjunction with the present invention. In one embodiment, a device is used to assess levels of a protein which has been administered in the form of a modified mRNA. The device may comprise a blood, urine or other biofluidic test. It may be as large as to include an automated central lab platform or a small decentralized bench top device.

Kits.

The invention provides a variety of kits for conveniently and/or effectively carrying out methods of the present invention. Typically kits will comprise sufficient amounts and/or numbers of components to allow a user to perform multiple treatments of a subject(s) and/or to perform multiple experiments.

In one embodiment, the levels of a modified mRNA of the present invention may be measured by immunoassay. In this embodiment, the assay may be used to assess levels of modified mRNA or its activated form or a variant delivered as or in response to the administration of the modified mRNA.

Dressings and Bandages.

The invention provides a variety of dressings (e.g., wound dressings) or bandages (e.g., adhesive bandages) for conveniently and/or effectively carrying out methods of the present invention. Typically dressings or bandages will comprise sufficient amounts of pharmaceutical compositions and/or modified nucleic acids described herein to allow a user to perform multiple treatments of a subject(s).

Animal Models.

Anti-microbial agents (e.g., anti-microbial polypeptides) can be tested in healthy animals (e.g., mice) exposed to specific microbial pathogens (e.g., bacteria). Anti-microbial agents (e.g., anti-microbial polypeptides) can also be tested in immunodeficient animal (e.g., mouse) models to test infection process without interference from other immune mechanisms except innate immunity.

Severe Combined Immunodeficiency (SCID) is a severe immunodeficiency genetic disorder that is characterized by the complete inability of the adaptive immune system to mount, coordinate, and sustain an appropriate immune response, usually due to absent or atypical T and B lymphocytes. Scid mice are important tools for researching hematopoiesis, innate and adaptive immunity, autoimmunity, infectious diseases, cancer, vaccine development, and regenerative medicine in vivo.

Strain NOD.Cg-Prkdc$^{scid}$ Il2rg$^{tm1Wjl}$/SzJ (005557 Jacson Lab), commonly known as NOD scid gamma (NSG), is the latest breakthrough in the development of immunodeficient models. It combines the innate immunity deficiencies of the NOD/ShiLtJ background, the scid mutation, and IL2 receptor gamma chain (Il2rg) deficiency. The latter two deficiencies combine to eliminate mature T cells, B cells, and NK cells. Because the Il2rg knockout prevents the development of lymphoma, NSG mice survive longer than other scid strains, enabling long-term experiments.

The B6 scid—strain B6.CB17-Prkdc$^{scid}$/SzJ (001913, Jacson Lab), B6 scid mice lack most B and T cells. B6 scid is more severely immunodeficient and supports better engraftment of allogeneic and xenogeneic cells, tissues, and tumors than Foxn1$^{nu}$ mutant strains.

The humanized mouse model of HIV infection to investigate mechanisms of viral dissemination, of HIV-induced immune activation, and of HIV-induced immune dysfunction can be used too MGH. Another mouse model—EcoHIV infected about 75 percent of the mice tested, an efficiency rate comparable with that of HIV in humans. The EcoHIV infection was present in immune cells and white blood cells, the spleen, abdominal cavity and brain.

C57BL/6-Btk$^{tm1Arte}$ 9723-F-mouse model for Bruton's disease. Bruton's tyrosine kinase (Btk) is a member of the Tec kinase family and has been implicated in the primary immunodeficiency X-linked agammaglobulinemia. Btk is thought to play multiple roles in the haematopoietic system, including B-cell development, stimulation of mast cells and the onset of autoimmune diseases. The Btk (Bruton's tyrosine kinase) KinaseSwitch mouse strain carries point mutations at the genomic level at positions T474A/S538A in the ATP binding pocket of the Btk kinase domain (BtkT474A/S538A).

Definitions

Therapeutic Agent: The term "therapeutic agent" refers to any agent that, when administered to a subject, has a therapeutic, diagnostic, and/or prophylactic effect and/or elicits a desired biological and/or pharmacological effect.

Administered in combination: As used herein, the term "administered in combination" or "combined administration" means that two or more agents (e.g., a modified nucleic acid encoding an anti-microbial polypeptide (e.g., an anti-bacterial polypeptide), e.g., an anti-microbial polypeptide described herein and an anti-microbial agent (e.g., an anti-microbial polypeptide or a small molecule anti-microbial compound described herein)) are administered to a subject at the same time or within an interval such that there is overlap of an effect of each agent on the patient. In some embodiments, they are administered within about 60, 30, 15, 10, 5, or 1 minute of one another. In some embodiments, the administrations of the agents are spaced sufficiently close together such that a combinatorial (e.g., a synergistic) effect is achieved.

Animal: As used herein, the term "animal" refers to any member of the animal kingdom. In some embodiments, "animal" refers to humans at any stage of development. In some embodiments, "animal" refers to non-human animals at any stage of development. In certain embodiments, the non-human animal is a mammal (e.g., a rodent, a mouse, a rat, a rabbit, a monkey, a dog, a cat, a sheep, cattle, a primate, or a pig). In some embodiments, animals include, but are not limited to, mammals, birds, reptiles, amphibians, fish, and worms. In some embodiments, the animal is a transgenic animal, genetically-engineered animal, or a clone.

Approximately: As used herein, the term "approximately" or "about," as applied to one or more values of interest, refers to a value that is similar to a stated reference value. In certain embodiments, the term "approximately" or "about" refers to a range of values that fall within 25%, 20%, 19%, 18%, 17%, 16%, 15%, 14%, 13%, 12%, 11%, 10%, 9%, 8%, 7%, 6%, 5%, 4%, 3%, 2%, 1%, or less in either direction (greater than or less than) of the stated reference value unless otherwise stated or otherwise evident from the context (except where such number would exceed 100% of a possible value).

Associated with: As used herein, the terms "associated with," "conjugated," "linked," "attached," and "tethered," when used with respect to two or more moieties, means that the moieties are physically associated or connected with one another, either directly or via one or more additional moieties that serves as a linking agent, to form a structure that is sufficiently stable so that the moieties remain physically associated under the conditions in which the structure is used, e.g., physiological conditions. As used herein, the terms "associated with," when used with respect to a microorganism (e.g., a bacterium) and a disease, disorder, or condition, means the microorganisms (e.g., bacterium) is found more frequently (e.g., at least 10%, 25%, 50%, 75%, 100%, 200%, 500%, 1000% more frequently) in patients with the disease, disorder, or condition than in healthy controls and/or there is a frequent co-occurrence of the microorganisms (e.g., bacterium) in the disease, disorder, or condition. In some embodiments, the microorganisms (e.g., bacterium) can be a direct and/or singular cause of the disease, disorder, or condition. In some embodiments, the microorganisms (e.g., bacterium) can be a necessary, but not sufficient, cause of the disease, disorder, or condition (e.g., only causes the disease, disorder or condition in combination with one or more other causal factors (e.g., genetic factors, or toxin exposure)). In some embodiments, the bacterium can predispose to the development of or increase the risk of getting the disease, disorder, or condition. In some embodiments, the microorganisms (e.g., bacterium) can also be an "innocent bystander" that plays no significant role in the etiology of the disease, disorder, or condition but is more prevalent in patients with the disease, disorder, or condition for some reason such as the compromised immune response caused by the disease, disorder, or condition.

Biologically active: As used herein, the phrase "biologically active" refers to a characteristic of any substance that has activity in a biological system and/or organism. For instance, a substance that, when administered to an organism, has a biological effect on that organism, is considered to be biologically active. In particular embodiments, where a nucleic acid is biologically active, a portion of that nucleic acid that shares at least one biological activity of the whole nucleic acid is typically referred to as a "biologically active" portion.

Conserved: As used herein, the term "conserved" refers to nucleotides or amino acid residues of a polynucleotide sequence or amino acid sequence, respectively, that are those that occur unaltered in the same position of two or more related sequences being compared. Nucleotides or amino acids that are relatively conserved are those that are conserved amongst more related sequences than nucleotides or amino acids appearing elsewhere in the sequences. In some embodiments, two or more sequences are said to be "completely conserved" if they are 100% identical to one another. In some embodiments, two or more sequences are said to be "highly conserved" if they are at least 70% identical, at least 80% identical, at least 90% identical, or at least 95% identical to one another. In some embodiments, two or more sequences are said to be "highly conserved" if they are about 70% identical, about 80% identical, about 90% identical, about 95%, about 98%, or about 99% identical to one another. In some embodiments, two or more sequences are said to be "conserved" if they are at least 30% identical, at least 40% identical, at least 50% identical, at least 60% identical, at least 70% identical, at least 80% identical, at least 90% identical, or at least 95% identical to one another. In some embodiments, two or more sequences are said to be "conserved" if they are about 30% identical, about 40% identical, about 50% identical, about 60% identical, about 70% identical, about 80% identical, about 90% identical, about 95% identical, about 98% identical, or about 99% identical to one another.

Cytostatic: As used herein, "cytostatic" refers to inhibiting, reducing, suppressing the growth, division, or multiplication of a cell (e.g., a mammalian cell (e.g., a human cell)), bacterium, virus, fungus, protozoan, parasite, prion, or a combination thereof.

Cytotoxic: As used herein, "cytotoxic" refers to killing or causing injurious, toxic, or deadly effect on a cell (e.g., a mammalian cell (e.g., a human cell)), bacterium, virus, fungus, protozoan, parasite, prion, or a combination thereof.

Expression: As used herein, "expression" of a nucleic acid sequence refers to one or more of the following events: (1) production of an RNA template from a DNA sequence (e.g., by transcription); (2) processing of an RNA transcript (e.g., by splicing, editing, 5' cap formation, and/or 3' end processing); (3) translation of an RNA into a polypeptide or protein; and (4) post-translational modification of a polypeptide or protein.

Functional: As used herein, a "functional" biological molecule is a biological molecule in a form in which it exhibits a property and/or activity by which it is characterized.

Homology: As used herein, the term "homology" refers to the overall relatedness between polymeric molecules, e.g. between nucleic acid molecules (e.g. DNA molecules and/or RNA molecules) and/or between polypeptide molecules. In some embodiments, polymeric molecules are considered to be "homologous" to one another if their sequences are at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% identical. In some embodiments, polymeric molecules are considered to be "homologous" to one another if their sequences are at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% similar. The term "homologous" necessarily refers to a comparison between at least two sequences (nucleotides sequences or amino acid sequences). In accordance with the invention, two nucleotide sequences are considered to be homologous if the polypeptides they encode are at least about 50% identical, at least about 60% identical, at least about 70% identical, at least about 80% identical, or at least about 90% identical for at least one stretch of at least about 20 amino acids. In some embodiments, homologous nucleotide sequences are characterized by the ability to encode a stretch of at least 4-5 uniquely specified amino acids. Both the identity and the approximate spacing of these amino acids relative to one another must be considered for nucleotide sequences to be considered homologous. For nucleotide sequences less than 60 nucleotides in length, homology is determined by the ability to encode a stretch of at least 4-5 uniquely specified amino acids. In accordance with the invention, two protein sequences are considered to be homologous if the proteins are at least about 50% identical, at least about 60% identical, at least about 70% identical, at least about 80% identical, or at least about 90% identical for at least one stretch of at least about 20 amino acids.

Identity: As used herein, the term "identity" refers to the overall relatedness between polymeric molecules, e.g., between nucleic acid molecules (e.g. DNA molecules and/or RNA molecules) and/or between polypeptide molecules. Calculation of the percent identity of two nucleic acid sequences, for example, can be performed by aligning the two sequences for optimal comparison purposes (e.g., gaps can be introduced in one or both of a first and a second nucleic acid sequences for optimal alignment and non-identical sequences can be disregarded for comparison purposes). In certain embodiments, the length of a sequence aligned for comparison purposes is at least 30%, at least 40%, at least 50%, at least 60%, at least 70%, at least 80%, at least 90%, at least 95%, or 100% of the length of the reference sequence. The nucleotides at corresponding nucleotide positions are then compared. When a position in the first sequence is occupied by the same nucleotide as the corresponding position in the second sequence, then the molecules are identical at that position. The percent identity between the two sequences is a function of the number of identical positions shared by the sequences, taking into account the number of gaps, and the length of each gap, which needs to be introduced for optimal alignment of the two sequences. The comparison of sequences and determination of percent identity between two sequences can be accomplished using a mathematical algorithm. For example, the percent identity between two nucleotide sequences can be determined using methods such as those described in Computational Molecular Biology, Lesk, A. M., ed., Oxford University Press, New York, 1988; Biocomputing: Informatics and Genome Projects, Smith, D. W., ed., Academic Press, New York, 1993; Sequence Analysis in Molecular Biology, von Heinje, G., Academic Press, 1987; Computer Analysis of Sequence Data, Part I, Griffin, A. M., and Griffin, H. G., eds., Humana Press, New Jersey, 1994; and Sequence Analysis Primer, Gribskov, M. and Devereux, J., eds., M Stockton Press, New York, 1991; each of which is incorporated herein by reference. For example, the percent identity between two nucleotide sequences can be determined using the algorithm of Meyers and Miller (CABIOS, 1989, 4:11-17), which has been incorporated into the ALIGN program (version 2.0) using a PAM120 weight residue table, a gap length penalty of 12 and a gap penalty of 4. The percent identity between two nucleotide sequences can, alternatively, be determined using the GAP program in the GCG software package using an NWSgapdna.CMP matrix. Methods commonly employed to determine percent identity between sequences include, but are not limited to those disclosed in Carillo, H., and Lipman, D., SIAM J Applied Math., 48:1073 (1988); incorporated herein by reference. Techniques for determining identity are codified in publicly available computer programs. Exemplary computer software to determine homology between two sequences include, but are not limited to, GCG program package, Devereux, J., et al., *Nucleic Acids Research*, 12(1), 387 (1984)), BLASTP, BLASTN, and FASTA Atschul, S. F. et al., *J. Molec. Biol.*, 215, 403 (1990)).

Inhibit expression of a gene: As used herein, the phrase "inhibit expression of a gene" means to cause a reduction in the amount of an expression product of the gene. The expression product can be an RNA transcribed from the gene (e.g., an mRNA) or a polypeptide translated from an mRNA transcribed from the gene. Typically a reduction in the level of an mRNA results in a reduction in the level of a polypeptide translated therefrom. The level of expression may be determined using standard techniques for measuring mRNA or protein.

In vitro: As used herein, the term "in vitro" refers to events that occur in an artificial environment, e.g., in a test tube or reaction vessel, in cell culture, in a Petri dish, etc., rather than within an organism (e.g., animal, plant, or microbe).

In vivo: As used herein, the term "in vivo" refers to events that occur within an organism (e.g., animal, plant, or microbe).

Isolated: As used herein, the term "isolated" refers to a substance or entity that has been (1) separated from at least some of the components with which it was associated when initially produced (whether in nature or in an experimental setting), and/or (2) produced, prepared, and/or manufactured by the hand of man. Isolated substances and/or entities may be separated from at least about 10%, about 20%, about 30%, about 40%, about 50%, about 60%, about 70%, about 80%, about 90%, or more of the other components with which they were initially associated. In some embodiments, isolated agents are more than about 80%, about 85%, about 90%, about 91%, about 92%, about 93%, about 94%, about 95%, about 96%, about 97%, about 98%, about 99%, or more than about 99% pure. As used herein, a substance is "pure" if it is substantially free of other components.

Preventing: As used herein, the term "preventing" refers to partially or completely delaying onset of a microbial infection; partially or completely delaying onset of one or more symptoms, features, or clinical manifestations of a particular disease, disorder, and/or condition associated with a microbial infection; partially or completely delaying onset of one or more symptoms, features, or manifestations of a particular disease, disorder, and/or condition prior to an identifiable microbial infection; partially or completely delaying progression from an latent microbial infection to an active microbial infection or a particular disease, disorder and/or condition; and/or decreasing the risk of developing pathology associated with the microbial infection or the disease, disorder, and/or condition.

Similarity: As used herein, the term "similarity" refers to the overall relatedness between polymeric molecules, e.g. between nucleic acid molecules (e.g. DNA molecules and/or RNA molecules) and/or between polypeptide molecules. Calculation of percent similarity of polymeric molecules to one another can be performed in the same manner as a calculation of percent identity, except that calculation of percent similarity takes into account conservative substitutions as is understood in the art.

Subject: As used herein, the term "subject" or "patient" refers to any organism to which a composition in accordance with the invention may be administered, e.g., for experimental, diagnostic, prophylactic, and/or therapeutic purposes. Typical subjects include animals (e.g., mammals such as mice, rats, rabbits, non-human primates, and humans) and/or plants.

Substantially: As used herein, the term "substantially" refers to the qualitative condition of exhibiting total or near-total extent or degree of a characteristic or property of interest. One of ordinary skill in the biological arts will understand that biological and chemical phenomena rarely, if ever, go to completion and/or proceed to completeness or achieve or avoid an absolute result. The term "substantially" is therefore used herein to capture the potential lack of completeness inherent in many biological and chemical phenomena.

Suffering from: An individual who is "suffering from" a disease, disorder, and/or condition has been diagnosed with or displays one or more symptoms of a disease, disorder, and/or condition.

Susceptible to: An individual who is "susceptible to" a disease, disorder, and/or condition has not been diagnosed with and/or may not exhibit symptoms of the disease, disorder, and/or condition. In some embodiments, an individual who is susceptible to a disease, disorder, and/or condition (for example, cancer) may be characterized by one or more of the following: (1) a genetic mutation associated with development of the disease, disorder, and/or condition; (2) a genetic polymorphism associated with development of the disease, disorder, and/or condition; (3) increased and/or decreased expression and/or activity of a protein and/or nucleic acid associated with the disease, disorder, and/or condition; (4) habits and/or lifestyles associated with development of the disease, disorder, and/or condition; (5) a family history of the disease, disorder, and/or condition; and (6) exposure to and/or infection with a microbe associated with development of the disease, disorder, and/or condition. In some embodiments, an individual who is susceptible to a disease, disorder, and/or condition will develop the disease, disorder, and/or condition. In some embodiments, an individual who is susceptible to a disease, disorder, and/or condition will not develop the disease, disorder, and/or condition.

Therapeutically effective amount: As used herein, the term "therapeutically effective amount" means an amount of an agent to be delivered (e.g., nucleic acid, drug, therapeutic agent, diagnostic agent, prophylactic agent, etc.) that is sufficient, when administered to a subject suffering from or susceptible to a disease, disorder, and/or condition, to treat, improve symptoms of, diagnose, prevent, and/or delay the onset of the disease, disorder, and/or condition.

Transcription factor: As used herein, the term "transcription factor" refers to a DNA-binding protein that regulates transcription of DNA into RNA, for example, by activation or repression of transcription. Some transcription factors effect regulation of transcription alone, while others act in concert with other proteins. Some transcription factor can both activate and repress transcription under certain conditions. In general, transcription factors bind a specific target sequence or sequences highly similar to a specific consensus sequence in a regulatory region of a target gene. Transcription factors may regulate transcription of a target gene alone or in a complex with other molecules.

Treating: As used herein, the term "treating" refers to partially or completely alleviating, ameliorating, improving, relieving, delaying onset of, inhibiting progression of, reducing severity of, and/or reducing incidence of one or more symptoms, features, or clinical manifestations of a particular disease, disorder, and/or condition. For example, "treating" microbial infections may refer to inhibit or reduce the survival, growth, and/or spread of the microbial pathogens. "Treating" cancer may refer to inhibiting survival, growth, and/or spread of a tumor. Treatment may be administered to a subject who does not exhibit signs of a disease, disorder, and/or condition (e.g., prior to an identifiable microbial infection) and/or to a subject who exhibits only early signs of a disease, disorder, and/or condition for the purpose of decreasing the risk of developing pathology associated with the disease, disorder, and/or condition.

Unmodified: As used herein, "unmodified" refers to the protein or agent prior to being modified.

Equivalents And Scope

Those skilled in the art will recognize, or be able to ascertain using no more than routine experimentation, many equivalents to the specific embodiments, described herein. The scope of the present invention is not intended to be limited to the above Description, but rather is as set forth in the appended claims.

Those skilled in the art will recognize, or be able to ascertain using no more than routine experimentation, many equivalents to the specific embodiments in accordance with the invention described herein. The scope of the present invention is not intended to be limited to the above Description, but rather is as set forth in the appended claims.

In the claims articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention includes embodiments in which more than one, or all of the group members are present in, employed in, or otherwise relevant to a given product or process. Furthermore, it is to be understood that the invention encompasses all variations, combinations, and permutations in which one or more limitations, elements, clauses, descriptive terms, etc., from one or more of the listed claims is introduced into another claim. For example, any claim that is dependent on another claim can be modified to include one or more limitations found in any other claim that is dependent on the same base claim. Furthermore, where the claims recite a composition, it is to be understood that methods of using the composition for any of the purposes disclosed herein are included, and methods of making the composition according to any of the methods of making disclosed herein or other methods known in the art are included, unless otherwise indicated or unless it would be evident to one of ordinary skill in the art that a contradiction or inconsistency would arise.

Where elements are presented as lists, e.g., in Markush group format, it is to be understood that each subgroup of the elements is also disclosed, and any element(s) can be removed from the group. It should it be understood that, in general, where the invention, or aspects of the invention, is/are referred to as comprising particular elements, features, etc., certain embodiments of the invention or aspects of the invention consist, or consist essentially of, such elements, features, etc. For purposes of simplicity those embodiments have not been specifically set forth in haec verba herein. It is also noted that the term "comprising" is intended to be open and permits the inclusion of additional elements or steps.

Where ranges are given, endpoints are included. Furthermore, it is to be understood that unless otherwise indicated or otherwise evident from the context and understanding of one of ordinary skill in the art, values that are expressed as ranges can assume any specific value or subrange within the stated ranges in different embodiments of the invention, to the tenth of the unit of the lower limit of the range, unless the context clearly dictates otherwise.

In addition, it is to be understood that any particular embodiment of the present invention that falls within the prior art may be explicitly excluded from any one or more of the claims. Since such embodiments are deemed to be known to one of ordinary skill in the art, they may be excluded even if the exclusion is not set forth explicitly herein. Any particular embodiment of the compositions of the invention (e.g., any nucleic acid or protein encoded thereby; any method of production; any method of use; etc.) can be excluded from any one or more claims, for any reason, whether or not related to the existence of prior art.

All cited sources, for example, references, publications, databases, database entries, and art cited herein, are incorporated into this application by reference, even if not expressly stated in the citation. In case of conflicting statements of a cited source and the instant application, the statement in the instant application shall control.

EXAMPLES

Modified mRNAs (mmRNAs) according to the invention can be made using standard laboratory methods and materials. The open reading frame (ORF) of the gene of interest is flanked by a 5' untranslated region (UTR) containing a strong Kozak translational initiation signal and a 3' UTR (e.g., an alpha-globin 3' UTR) terminating with an oligo(dT) sequence for templated addition of a polyA tail. The mmRNAs can be modified with pseudouridine (ψ) and 5-methylcytidine (5 meC) to reduce the cellular innate immune response. Kariko K et al. Immunity 23:165-75 (2005), Kariko K et al. Mol Ther 16:1833-40 (2008), Anderson B R et al. NAR (2010).

The cloning, gene synthesis and vector sequencing can be performed by DNA2.0 Inc. (Menlo Park, Calif.). The ORFs can be restriction digested and used for cDNA synthesis using tailed-PCR. This tailed-PCR cDNA product can be used as the template for the modified mRNA synthesis reaction using 25 mM each modified nucleotide mix (modified U/C was manufactured by TriLink Biotech, San Diego, Calif., unmodifed A/G was purchased from Epicenter Biotechnologies, Madison, Wis.) and CellScript MegaScript™ (Epicenter Biotechnologies, Madison, Wis.) complete mRNA synthesis kit. The in vitro transcription reaction can be run for 3-4 hours at 37° C. PCR reaction can use HiFi PCR 2X Master Mix™ (Kapa Biosystems, Woburn, Mass.). The in vitro transcribed mRNA product can be run on an agarose gel and visualized. mRNA can be purified with Ambion/Applied Biosystems (Austin, Tex.) MEGAClear RNA™ purification kit. PCR reaction can be purified using PureLink™ PCR purification kit (Invitrogen, Carlsbad, Calif.) or PCR cleanup kit (Qiagen, Valencia, Calif.). The product can be quantified on Nanodrop™ UV Absorbance (ThermoFisher, Waltham, Mass.). Quality, UV absorbance quality and visualization of the product can be performed on a 1.2% agarose gel. The product can be resuspended in TE buffer.

When transfected into mammalian cells, the modified mRNAs may have a stability of between 12-18 hours.

For animal experiments, the IV delivery solution can be 150 mM NaCl, 2 mM CaCl2, 2 mM Na+-phosphate, and 0.5 mM EDTA, pH 6.5 and 10 µl lipofectamine (RNAiMax™, Invitrogen, Carlsbad, Calif.).

Example 1

Use of Synthetic Modified mRNAs to Produce Functional Anti-Microbial Peptides and Proteins by Human Cells The goal of this example is to express several functional AMPs from modified RNA in several human cell lines to test antibacterial effect of AMPs with distinct patterns of natural distribution and activities.

Each AMP (hBD-2, LL-37, or RNAse-7) is cloned into propagation plasmid in connection with sequences required for efficient translation and prolonged life of mRNA in cell with globin 5' and 3' UTRs and polyA tail. The mRNAs containing modified nucleotides and/or backbone modifications are transcribed using a standard T7 RNA polymerase-dependent transcription system from plasmid templates. Those mRNAs are transfected into a panel of primary human cell lines including keratinocytes and fibroblasts using a lipophilic carrier. The intensive optimization of expression is performed in matrix-type experiments focusing on dose, media and delivery reagents selection. Then a dose titration curve of AMP expression can be established in a repeat administration protocol. As a positive transfection control, each construct encodes the EGFP gene for visualization. The expressed and secreted polypeptides are detected by corresponded antibodies by ELISA and Western blots. The specific antimicrobial activity is tested in corresponded microbiological plate assays or antibacterial neutralization assays required for the selection of targeted microorganisms. The strain collection can be tested for sensitivity to AMPs by determining their minimal inhibitory concentration (MIC) using those methods. Apoptosis is monitored using FACS with Annexin VCy5.5 and DAPI staining Apoptotic DNA fragmentation can also be observed by agarose gel electrophoresis. Interferon production is assayed from the cell supernatant using standard ELISA techniques and qPCR of inflammatory gene products. Experiments can be carried out with a collection of different microorganisms including *Listeria monocytogenes* strains and *Staphylococcus aureus* strains representing different lineages and serotypes (*L. monocytogenes*), spa types (*S. aureus*), and origins (food processing environment, food products, and human clinical isolates).

Example 2

The Combinatory Effect of Modified mRNAs for Polypeptides with Different Antimicrobial Mechanisms on Bacterial Resistance The goal of this example is to show increase in antibacterial potency of AMP by co-expression of combination of several functional AMPs with distinct patterns of natural distribution and activities in human cell lines and test antibacterial effect of combination of AMPs on microorganisms partially resistant against one of AMP. AMPs can interact with the membrane lipids and form a channel through which ions can escape, upsetting homeostasis and eventually leading to cell lysis. However, other mechanisms for AMP activity may include activation of autolysis as well as nonlytic mechanisms such as inhibition of protein synthesis, degradation of proteins required for DNA replication, and interference with the transport and energy metabolism 7(Gob). The approach described in this example is to reduce bacterial resistance and cover a wider variety of pathogenic microorganisms by applying the desired mixture of two and more in vitro-generated, modified synthetic mRNAs encoded AMPs (e.g., hBD-2, LL-37, RNAse-7). The library of AMPs with most studied and different mechanisms of action can be cloned and transcribed as above. Following by the developed optimal protocol for modified mRNA transfection, many possible combinations of target AMPs can be expressed in a panel of human cell lines including keratinocytes and fibroblasts using a lipophilic carrier in described anti-bacterial assays in a systematic manner looking for the lowest possible dose for bacteriostatic effect on selected panel of microorganisms.

Example 3

The Combinatory Effect of Modified mRNA for AMP and Conventional Antibiotic on Bacterial Resistance The goal of this example is to show increase in antibacterial potency of AMP distinct patterns of natural distribution and activities expressed in human cell lines from modified RNA by combination with one or more traditional antibiotic drugs test antibacterial effect of combination of AMPs on microorganisms partially resistant against those antibiotic drugs.

Human peptide antibiotics, in combination with wide variety of other natural polypeptides from other species and conventional antibiotics can be used as therapeutic agents, avoiding the problems of acquired resistance. The approach described in this example is to reduce bacterial resistance and cover a wider variety of pathogenic microorganisms by applying the desired mixture of one or more in vitro-generated, modified synthetic mRNAs encoded AMPs and one or more traditional antibiotics and to show synergetic effect of combination of panel of traditional antibiotics and panel of AMPs. For example, the hBD-2, LL-37, and RNAse-7 can be used along and in all possible combinations. The following exemplary antibiotics can be used in this example: penicillins such as penicillin and amoxicillin; cephalosporins such as cephalexin (Keflex); macrolides such as erythromycin (E-Mycin), clarithromycin (Biaxin), and azithromycin (Zithromax); fluoroquinolones such as ciprofloxacin (Cipro), levofloxacin (Levaquin), and ofloxacin (Floxin); sulfonamides such as co-trimoxazole (Bactrim) and trimethoprim (Proloprim); tetracyclines such as tetracycline (Sumycin, Panmycin) and doxycycline (Vibramycin); and aminoglycosides such as gentamicin (Garamycin) and tobramycin (Tobrex). The library of AMPs with most studied and different mechanisms of action can be cloned and transcribed as above. Following by the developed optimal protocol for modified mRNA transfection, many possible combinations of target AMPs can be expressed in a panel of human cell lines including keratinocytes and fibroblasts using a lipophilic carrier in described antibacterial assays in a systematic manner looking for the lowest possible dose for bacteriostatic effect on selected panel of microorganisms including microorganisms known to be resistant to one or more traditional antibiotics.

Example 4

The Modified mRNA Technology as a Tool for Developing Novel Antibiotic Activity

The goal of this example is to develop efficient protocol for discovery, validation and development of new AMPs.

The AMP validation protocol in high throughput manner can be developed. There have been many new AMPs recently discovered, but their mechanisms of action and utility for therapeutic applications remain unknown. Modified RNA technology allows for the simultaneous testing of new AMPs for human cell toxicity and antimicrobial activities. The sequence of newly discovered candidates can be cloned for in vitro RNA synthesis and testing in high throughput screens without actual peptide expression. Following by the optimal protocol for modified mRNA transfection, several new AMPs expressed in human cells against a panel of microorganisms can be tested. The AMP improvement protocol can be developed. 2-3 known AMPs are selected and a systematic walkthrough mutagenesis by PCR and clone resulting constructs in plasmid vectors are performed. The library of those mutants can be tested one-by-one in a high throughput screen according to developed protocols in comparison to wild type peptides. Functional domains in testing proteins and peptides associated with human cytotoxicity and domains linked to certain mechanisms of antimicrobial activities can be identified. The results of those scanning efforts can allow engineering AMPs with optimal non-toxic but rapid bacteriostatic activities.

Example 5

The Effect of Synthetic Modified mRNAs Coding Intracellular Communication Factors on the Expression of AMPs in Human Cells The goal of this example is to use modified mRNAs coding intracellular communication factors to induce innate immune system including expression of AMPs.

The expression of AMP genes in a variety of epithelial cells can be enhanced using specific nutrients, vitamins (D) and other short chain fatty acids as therapeutic treatment. The opportunity for more specific signal for expression of AMP can be investigated. hBD-2 messenger RNA expression in foreskin-derived keratinocytes was greatly up-regulated with TNF-α within 1 h of stimulation and persisted for more than 48 h. The TNF-α gene can be used for synthesis of modified mRNA and transfected into a panel of primary human cell lines including keratinocytes and fibroblasts using a lipophilic carrier. It can be used to test expression of several AMPs including hBD-2 in human cells. The expressed TNF-α and secreted AMPs can be detected by corresponded antibodies by ELISA and Western blots. The specific anti-microbial activity can be tested in corresponded microbiological plate assays or anti-bacterial neutralization assays required for the selection of targeted microorganisms. Apoptosis can be monitored using FACS with Annexin VCy5.5 and DAPI staining Apoptotic DNA fragmentation can also be observed by agarose gel electrophoresis. Interferon production can be assayed from the cell supernatant using standard ELISA techniques and qPCR of inflammatory gene products.

Example 6

Use of Synthetic Modified mRNAs to Produce Functional Antimicrobial Peptides and Proteins by Animal Cells for Development of Antibiotics for Agriculture Industry The goal of this example is to express several functional AMPs from modified RNA in several animal cell lines to test anti-bacterial effect of AMPs with distinct patterns of natural distribution and activities to test possibility to use modified RNAs as antibiotics in agriculture.

Each AMP (hBD-2, LL-37, and RNAse-7) can be cloned into propagation plasmid in connection with sequences required for efficient translation and prolonged life of mRNA in cell with globin 5' and 3' UTRs and polyA tail. The mRNAs containing modified nucleotides and/or backbone modifications can be transcribed using a standard T7 RNA polymerase-dependent transcription system from plasmid templates. Those mRNAs are transfected into a panel of primary human cell lines including keratinocytes and fibroblasts using a lipophilic carrier. The intensive optimization of expression can be performed in matrix-type experiments focusing on dose, media and delivery reagents selection. A dose titration curve of AMP expression can be established in a repeat administration protocol. As a positive transfection control, each construct encodes the EGFP gene for visualization. The expressed and secreted polypeptides can be detected by corresponded antibodies by ELISA and Western blots. The specific antimicrobial activity can be tested in corresponded microbiological plate assays or antibacterial neutralization assays required for the selection of targeted microorganisms. Apoptosis is monitored using FACS with Annexin VCy5.5 and DAPI staining Apoptotic DNA fragmentation can also be observed by agarose gel electrophoresis. Interferon production can be assayed from the cell supernatant using standard ELISA techniques and qPCR of inflammatory gene products.

Example 7

In Vitro Selection of Anti-Viral Inhibitory Peptides Encoded by Synthetic Modified mRNA The viral lifecycle may be inhibited by antibody mimetic anti-viral peptides at a number of points. Viral entry into the host cell can be prevented by inhibitory peptides that ameliorate the proper folding of the viral hairpin fusion complex. Alternatively, intracellular viral propagation may be inhibited by antiviral peptides directed against viral capsid assembly thereby preventing the formation of functional infectious viral particles. The goal of this example is to identify anti-viral peptides using mRNA-display technology directed against specific viral capsid proteins or viral envelope proteins from HIV, herpes or influenza viruses. The mRNA display in vitro selection can be performed similar to previously described methods (Wilson et al., *PNAS USA*, 2001, 98(7):375). Briefly, a synthetic oligonucleotide library is constructed containing ~$10^{13}$ unique sequences in a 30-nt randomized region for selection of a 10aa antiviral peptide. The oligonucleotide library is synthesized containing a 3'-puromycin nucleotide analog used to covently attach the nascent peptide chain to its encoded mRNA during the in vitro translation step in rabbit reticulocyte lysate. A preselection round can filter the mRNA peptide-display library over a ligand-free column to remove non-specific binding partners from the pool. The selection rounds can then proceed through passage and incubation over a target viral-protein functionalized selection column followed by a wash through selection buffer (20 mM Tris-HCl, pH7.5; 100 mM NaCl). The bound peptides are eluted with an alkaline elution buffer (0.1M KOH) and the sequence information in the peptide is recovered through RT-PCR of the attached mRNA. Mutagenic PCR may be performed between selection rounds to further optimized binding affinity and peptide stability. Based on previous mRNA-display selections (Wilson et al., *PNAS USA*, 2001, 98(7):375), this selection is expected to recover high affinity ($K_d$~50 pM-50 nM) anti-viral peptides after 15-20 rounds of selection. To test in vivo functionality of the anti-viral peptide, synthetic modified mRNAs encoding the anti-viral peptide are transfected into target cells. Post-transfection culture transduction with infectious virus or mock-virus are performed and viral propagation can be monitored through standard pfu counts and qPCR of viral genomic material. Cells transfected with synthetic mRNAs encoding the appropriate anti-viral peptide inhibitor are expected to reduce viral propagation, display reduced pfu counts, reduced viral RNA or DNA in culture, and increase cell survival. In vivo efficacy, PK and toxicology can be studied in appropriate animal models.

Lengthy Table

The patent application contains a lengthy table section. A copy of the table is available in electronic form from the USPTO web site. An electronic copy of the table will also be available from the USPTO upon request and payment of the fee set forth in 37 CFR 1.19(b)(3).

SEQUENCE LISTING (2915 sequences)

SEQ ID NO: 1 - protein, 37 aa, Androctonus australis
GFGCPFNQGACHRHCRSIRRRGGYCAGLFKQTCTCYR

SEQ ID NO: 2 - protein, 29 aa, Amaranthus caudatus
VGECVRGRCPSGMCCSQFGYCGKGPKYCG

SEQ ID NO: 3 - protein, 30 aa, Amaranthus caudatus
VGECVRGRCPSGMCCSQFGYCGKGPKYCGR

SEQ ID NO: 4 - protein, 33 aa, Phyllomedusa bicolor
GLWSKIKEVGKEAAKAAAKAAGKAALGAVSEAV

SEQ ID NO: 5 - protein, 25 aa, Androctonus australis
RSVCRQIKICRRRGGCYYKCTNRPY

SEQ ID NO: 6 - protein, 37 aa, Homo sapiens
LLGDFFRKSKEKIGKEFKRIVQRIKDFLRNLVPRTES

SEQ ID NO: 7 - protein, 22 aa, Spinacia oleracea
  MOD_RES (1)..(1): Any amino acid
XTCESPSHKFKGPCATNRNCES

SEQ ID NO: 8 - protein, 52 aa, Spinacia oleracea
GIFSSRKCKTPSKTFKGICTRDSNCDTSCRYEGYPAGDCKGIRRRCMCSKPC

SEQ ID NO: 9 - protein, 25 aa, Spinacia oleracea
GIFSSRKCKTVSKTFRGICTRNANC

SEQ ID NO: 10 - protein, 23 aa, Spinacia oleracea
MFFSSKKCKTVSKTFRGPCVRNA

SEQ ID NO: 11 - protein, 24 aa, Spinacia oleracea
  MOD_RES (12)..(12): Any amino acid
MFFSSKKCKTVXKTFRGPCVRNAN

SEQ ID NO: 12 - protein, 23 aa, Drosophila melanogaster
QRPYTQPLIYYPPPPTPPRIYRA

SEQ ID NO: 13 - protein, 36 aa, Chinchilla lanigera
QRYFCRVRGGRCAALTCLPRETQIGRCSVKGRKCCR

SEQ ID NO: 14 - protein, 50 aa, Mus musculus
LDTIKCLQGNNNCHIQKCPWFLLQVSTCYKGKGRCCQKRRWFARSHVYHV

SEQ ID NO: 15 - protein, 42 aa, Sus scrofa
KNIGNSVSCLRNKGVCMPGKCAPKMKQIGTCGMPQVKCCKRK

SEQ ID NO: 16 - protein, 37 aa, Mus musculus
DQYKCLQHGGFCLRSSCPSNTKLQGTCKPDKPNCCKS

SEQ ID NO: 17 - protein, 38 aa, Bos taurus
DFASCHTNGGICLPNRCPGHMIQIGICFRPRVKCCRSW

SEQ ID NO: 18 - protein, 40 aa, Bos taurus
EGVRSYLSCWGNRGICLLNRCPGRMRQIGTCLAPRVKCCR

SEQ ID NO: 19 - protein, 38 aa, Bos taurus
GPLSCRRNGGVCIPIRCPGPMRQIGTCFGRPVKCCRSW

SEQ ID NO: 20 - protein, 38 aa, Bos taurus
GPLSCGRNGGVCIPIRCPVPMRQIGTCFGRPVKCCRSW

SEQ ID NO: 21 - protein, 42 aa, Bos taurus
SGISGPLSCGRNGGVCIPIRCPVPMRQIGTCFGRPVKCCRSW

SEQ ID NO: 22 - protein, 40 aa, Bos taurus
VRNHVTCRINRGFCVPIRCPGRTRQIGTCFGPRIKCCRSW

SEQ ID NO: 23 - protein, 42 aa, Bos taurus
EGVRNHVTCRINRGFCVPIRCPGRTRQIGTCFGPRIKCCRSW

SEQ ID NO: 24 - protein, 42 aa, Mus musculus
IGPDTKKCVQRKNACHYFECPWLYYSVGTCYKGKGKCCQKRY

SEQ ID NO: 25 - protein, 41 aa, Bos taurus
ERVRNPQSCRWNMGVCIPFLCRVGMRQIGTCFGPRVPCCRR

SEQ ID NO: 26 - protein, 40 aa, Bos taurus
EVVRNPQSCRWNMGVCIPISCPGNMRQIGTCFGPRVPCCR

SEQ ID NO: 27 - protein, 40 aa, Bos taurus
QVVRNPQSCRWNMGVCIPISCPGNMRQIGTCFGPRVPCCR

SEQ ID NO: 28 - protein, 41 aa, Mus musculus
QLINSPVTCMSYGGSCQRSCNGGFRLGGHCGHPKIRCCRRK

SEQ ID NO: 29 - protein, 42 aa, Bos taurus
QGVRNHVTCRIYGGFCVPIRCPGRTRQIGTCFGRPVKCCRRW

SEQ ID NO: 30 - protein, 42 aa, Bos taurus
EGVRNHVTCRIYGGFCVPIRCPGRTRQIGTCFGRPVKCCRRW

SEQ ID NO: 31 - protein, 40 aa, Bos taurus
QGVRNFVTCRINRGFCVPIRCPGHRRQIGTCLGPRIKCCR

SEQ ID NO: 32 - protein, 40 aa, Bos taurus
EGVRNFVTCRINRGFCVPIRCPGHRRQIGTCLGPRIKCCR

SEQ ID NO: 33 - protein, 36 aa, Bos taurus
NFVTCRINRGFCVPIRCPGHRRQIGTCLGPRIKCCR

SEQ ID NO: 34 - protein, 38 aa, Bos taurus
VRNFVTCRINRGFCVPIRCPGHRRQIGTCLGPQIKCCR

SEQ ID NO: 35 - protein, 41 aa, Gallus gallus
NNEAQCEQAGGICSKDHCFHLHTRAFGHCQRGVPCCRTVYD

SEQ ID NO: 36 - protein, 40 aa, Bos taurus
EGVRNFVTCRINRGFCVPIRCPGHRRQIGTCLGPQIKCCR

SEQ ID NO: 37 - protein, 40 aa, Bos taurus
QGVRNFVTCRINRGFCVPIRCPGHRRQIGTCLAPQIKCCR

SEQ ID NO: 38 - protein, 45 aa, Homo sapiens
GIINTLQKYYCRVRGGRCAVLSCLPKEEQIGKCSTRGRKCCRRKK

SEQ ID NO: 39 - protein, 79 aa, Tachypleus tridentatus
NPLIPAIYIGATVGPSVWAYLVALVGAAAVTAANIRRASSDNHSCAGNRGWCRSKCFRHEYVDTYYSAVCGRYFCCRSR

SEQ ID NO: 40 - protein, 24 aa, Odorrana grahami
FLPLLAGLAANFLPKIFCKITKKC

SEQ ID NO: 41 - protein, 33 aa, Odorrana grahami
GLLDTFKNLALNAAKSAGVSVLNSLSCKLSKTC

SEQ ID NO: 42 - protein, 37 aa, Odorrana grahami
GLFTLIKGAAKLIGKTVAKEAGKTGLELMACKITNQC

SEQ ID NO: 43 - protein, 24 aa, Pelophylax porosus
  Pelophylax porosus brevipodus
FLPVLAGIAAKVVPALFCKITKKC

SEQ ID NO: 44 - protein, 24 aa, Rana berlandieri
FLPFIAGMAAKFLPKIFCAISKKC

SEQ ID NO: 45 - protein, 24 aa, Rana berlandieri
FLPAIAGMAAKFLPKIFCAISKKC

SEQ ID NO: 46 - protein, 24 aa, Rana berlandieri
FLPFIAGVAAKFLPKIFCAISKKC

SEQ ID NO: 47 - protein, 24 aa, Rana berlandieri
FLPAIAGVAAKFLPKIFCAISKKC

SEQ ID NO: 48 - protein, 24 aa, Rana berlandieri
FLPAIVGAAAKFLPKIFCVISKKC

SEQ ID NO: 49 - protein, 24 aa, Rana berlandieri
FLPFIAGMAANFLPKIFCAISKKC

SEQ ID NO: 50 - protein, 24 aa, Rana boylii
FLPILASLAAKFGPKLFCLVTKKC

SEQ ID NO: 51 - protein, 24 aa, Rana boylii
FLPILASLAAKLGPKLFCLVTKKC

SEQ ID NO: 52 - protein, 24 aa, Rana boylii
FLPILASLAATLGPKLLCLITKKC

SEQ ID NO: 53 - protein, 24 aa, Rana cascadee
FLPILAGLAAKIVPKLFCLATKKC

SEQ ID NO: 54 - protein, 20 aa, Rana dybowskii
FLSLALAALPKFLCLVFKKC

SEQ ID NO: 55 - protein, 20 aa, Rana dybowskii
FLSLALAALPKLFCLIFKKC

SEQ ID NO: 56 - protein, 20 aa, Rana dybowskii
FLPLLLAGLPKLLCLFFKKC

SEQ ID NO: 57 - protein, 17 aa, Rana dybowskii
FLIGMTHGLICLISRKC

SEQ ID NO: 58 - protein, 17 aa, Rana dybowskii
FLIGMTQGLICLITRKC

SEQ ID NO: 59 - protein, 24 aa, Pelophylax esculentus
FLPLLAGLAANFLPKIFCKITRKC

SEQ ID NO: 60 - protein, 24 aa, Pelophylax esculentus
FLPAIFRMAAKVVPTIICSITKKC

SEQ ID NO: 61 - protein, 24 aa, Pelophylax esculentus
VIPFVASVAAEMMPHVYCAASRKC

SEQ ID NO: 62 - protein, 24 aa, Pelophylax ridibundus
FLPLLAGLAANFFPKIFCKITRKC

SEQ ID NO: 63 - protein, 24 aa, Odorrana hosii
FLPAVLRVAAKIVPTVFCAISKKC

SEQ ID NO: 64 - protein, 24 aa, Odorrana hosii
FLPAVLRVAAQVVPTVFCAISKKC

SEQ ID NO: 65 - protein, 24 aa, Rana luteiventris
FLPMLAGLAASMVPKLVCLITKKC

SEQ ID NO: 66 - protein, 24 aa, Rana luteiventris
FLPMLAGLAASMVPKFVCLITKKC

SEQ ID NO: 67 - protein, 24 aa, Rana pipiens
FLPIIAGVAAKVFPKIFCAISKKC

SEQ ID NO: 68 - protein, 24 aa, Rana pipiens
FLPIIAGIAAKVFPKIFCAISKKC

SEQ ID NO: 69 - protein, 24 aa, Rana pipiens
FLPIIASVAAKVFSKIFCAISKKC

SEQ ID NO: 70 - protein, 24 aa, Rana pipiens
FLPIIASVAANVFSKIFCAISKKC

SEQ ID NO: 71 - protein, 24 aa, Rana pipiens
FLPIIASVAAKVFPKIFCAISKKC

SEQ ID NO: 72 - protein, 24 aa, Hylarana picturata
FMGGLIKAATKIVPAAYCAITKKC

SEQ ID NO: 73 - protein, 24 aa, Rana sylvatica
FLPVVAGLAAKVLPSIICAVTKKC

SEQ ID NO: 74 - protein, 24 aa, Rana sphenocephala
FLPAIVGAAGQFLPKIFCAISKKC

SEQ ID NO: 75 - protein, 24 aa, Rana sphenocephala
FLPAIVGAAGKFLPKIFCAISKKC

SEQ ID NO: 76 - protein, 24 aa, Rana sphenocephala
FFPIVAGVAGQVLKKIYCTISKKC

SEQ ID NO: 77 - protein, 23 aa, Rana sevosa
FLPLVRGAAKLIPSVVCAISKRC

SEQ ID NO: 78 - protein, 20 aa, Rana temporaria
VNPIILGVLPKFVCLITKKC

SEQ ID NO: 79 - protein, 17 aa, Rana temporaria
FITLLLRKFICSITKKC

SEQ ID NO: 80 - protein, 22 aa, Rana tsushimensis
FLGSIVGALASALPSLISKIRN

SEQ ID NO: 81 - protein, 33 aa, Pelophylax porosus
  Pelophylax porosus brevipodus
GLLDSLKGFAATAGKGVLQSLLSTASCKLAKTC

SEQ ID NO: 82 - protein, 33 aa, Rana dybowskii
GLLSAVKGVLKGAGKNVAGSLMDKLKCKLFGGC

SEQ ID NO: 83 - protein, 33 aa, Rana dybowskii
GLFDVVKGVLKGAGKNVAGSLLEQLKCKLSGGC

SEQ ID NO: 84 - protein, 33 aa, Rana dybowskii
GIFDVVKGVLKGVGKNVAGSLLEQLKCKLSGGC

SEQ ID NO: 85 - protein, 37 aa, Rana dybowskii
GLFSVVTGVLKAVGKNVAKNVGGSLLEQLKCKISGGC

SEQ ID NO: 86 - protein, 33 aa, Pelophylax esculentus
GIMDTLKNLAKTAGKGALQSLLNKASCKLSGQC

SEQ ID NO: 87 - protein, 33 aa, Pelophylax esculentus
GILDTLKNLAISAAKGAAQGLVNKASCKLSGQC

SEQ ID NO: 88 - protein, 33 aa, Pelophylax esculentus
GILDTLKNLAKTAGKGALQGLVKMASCKLSGQC

SEQ ID NO: 89 - protein, 34 aa, Pelophylax esculentus
GILLDKLKNFAKTAGKGVLQSLLNTASCKLSGQC

SEQ ID NO: 90 - protein, 29 aa, Pelophylax esculentus
GILDSLKNLAKNAGQILLNKASCKLSGQC

SEQ ID NO: 91 - protein, 29 aa, Pelophylax esculentus
GIFDKLKNFAKGVAQSLLNKASCKLSGQC

SEQ ID NO: 92 - protein, 33 aa, Pelophylax esculentus
GIMDTLKNLAKTAGKGALQSLVKMASCKLSGQC

SEQ ID NO: 93 - protein, 34 aa, Hylarana guentheri
GFSSLFKAGAKYLLKSVGKAGAQQLACKAANNCA

SEQ ID NO: 94 - protein, 30 aa, Hylarana guentheri
GVITDALKGAAKTVAAELLRKAHCKLTNSC

SEQ ID NO: 95 - protein, 31 aa, Hylarana guentheri
SIWEGIKNAGKGFLVSILDKVRCKVAGGCNP

SEQ ID NO: 96 - protein, 33 aa, Odorrana hosii
GLLDSLKNLAINAAKGAGQSVLNTLSCKLSKTC

SEQ ID NO: 97 - protein, 33 aa, Odorrana hosii
GLLDTLKNMAINAAKGAGQSVLNTLSCKLSKTC

SEQ ID NO: 98 - protein, 30 aa, Hylarana picturata
GAIKDALKGAAKTVAVELLKKAQCKLEKTC

SEQ ID NO: 99 - protein, 33 aa, Hylarana picturata
GFKGAFKNVMFGIAKSAGKSALNALACKIDKSC

SEQ ID NO: 100 - protein, 33 aa, Hylarana picturata
GLLDSFKNAMIGIAKSAGKTALNKIACKIDKTC

SEQ ID NO: 101 - protein, 33 aa, Hylarana picturata
GFLDSFKNAMIGVAKSAGKTALNTLACKIDKTC

SEQ ID NO: 102 - protein, 33 aa, Hylarana picturata
GFLDSFKNAMIGVAKSVGKTALSTLACKIDKSC

SEQ ID NO: 103 - protein, 17 aa, Rana sakuraii
FLPVILPVIGKLLNGIL

SEQ ID NO: 104 - protein, 33 aa, Rana sakuraii
GLFNVFKKVGKNVLKNVAGSLMDNLKCKVSGEC

SEQ ID NO: 105 - protein, 29 aa, Rana temporaria
GLWETIKNFGKKFTLNILHKLKCKIGGGC

SEQ ID NO: 106 - protein, 29 aa, Rana temporaria
GLWETIKNFGKKFTLNILHNLKCKIGGGC

SEQ ID NO: 107 - protein, 33 aa, Rana tsushimensis
  Rana tsushimensis Stejneger
GIMSLFKGVLKTAGKHVAGSLVDQLKCKITGGC

SEQ ID NO: 108 - protein, 39 aa, Bufo gargarizans
AGRGKQGGKVRAKAKTRSSRAGLQFPVGRVHRLLRKGNY

SEQ ID NO: 109 - protein, 21 aa, Bufo gargarizans
TRSSRAGLQFPVGRVHRLLRK

SEQ ID NO: 110 - protein, 34 aa, Canis lupus
  Canis lupus familiaris
KCWNLRGSCREKCIKNEKLYIFCTSGKLCCLKPK

SEQ ID NO: 111 - protein, 31 aa, Ascaris suum
SWLSKTAKKLENSAKKRISEGIAIAIQGGPR

SEQ ID NO: 112 - protein, 15 aa, Artificial Sequence
  Description of Artificial Sequence: Synthetic anti-microbial peptide
RRRFPWVCWPFLRRR

SEQ ID NO: 113 - protein, 7 aa, Artificial Sequence
  Description of Artificial Sequence: Synthetic anti-microbial peptide
FPWWWPF

SEQ ID NO: 114 - protein, 16 aa, Artificial Sequence
  Description of Artificial Sequence: Synthetic anti-microbial peptide
  MOD_RES (16)..(16): Any amino acid
ICLKKWPWWPWRRCKX

SEQ ID NO: 115 - protein, 14 aa, Artificial Sequence
  Description of Artificial Sequence: Synthetic anti-microbial peptide
  MOD_RES (14)..(14): Any amino acid
ILKKWPWWPWRRKX

SEQ ID NO: 116 - protein, 23 aa, Styela clava
VFQFLGKIIHHVGNFVHGFSHVF

SEQ ID NO: 117 - protein, 23 aa, Styela clava
VFQFLGRIIHHVGNFVHGFSHVF

SEQ ID NO: 118 - protein, 23 aa, Styela clava
VFHLLGKIIHHVGNFVYGFSHVF

SEQ ID NO: 119 - protein, 23 aa, Styela clava
AFKLLGRIIHHVGNFVYGFSHVF

SEQ ID NO: 120 - protein, 46 aa, Pisum sativum
KTCEHLADTYRGVCFTNASCDDHCKNKAHLISGTCHNWKCFCTQNC

SEQ ID NO: 121 - protein, 47 aa, Pisum sativum
KTCENLSGTFKGPCIPDGNCNKHCRNNEHLLSGRCRDDFRCWCTNRC

SEQ ID NO: 122 - protein, 38 aa, Aeshna cyanea
GFGCPLDQMQCHRHCQTITGRSGGYCSGPLKLTCTCYR

SEQ ID NO: 123 - protein, 44 aa, Galleria mellonella
DTLIGSCVWGATNYTSDCNAECKRRGYKGGHCGSFLNVNCWCEE

SEQ ID NO: 124 - protein, 51 aa, Bombus pascuorum
VTCDLLSIKGVAEHSACAANCLSMGKAGGRCENGICLCRKTTFKELWDKRF

SEQ ID NO: 125 - protein, 43 aa, Pyrrhocoris apterus
ATCDILSFQSQWVTPNHAGCALHCVIKGYKGGQCKITVCHCRR

SEQ ID NO: 126 - protein, 38 aa, Rhipicephalus microplus
GFGCPFNQGACHRHCRSIRRRGGYCAGLIKQTCTCYRN

SEQ ID NO: 127 - protein, 40 aa, Phlebotomus duboscqi
ATCDLLSAFGVGHAACAAHCIGHGYRGGYCNSKAVCTCRR

SEQ ID NO: 128 - protein, 36 aa, Dermacentor variabilis
GFGCPLNQGACHNHCRSIRRRGGYCSGIIKQTCTCY

SEQ ID NO: 129 - protein, 43 aa, Trypoxylus dichotomus
VTCDLLSFEAKGFAANHSLCAAHCLAIGRRGGSCERGVCICRR

SEQ ID NO: 130 - protein, 40 aa, Drosophila melanogaster
ATCDLLSKWNWNHTACAGHCIAKGFKGGYCNDKAVCVCRN

SEQ ID NO: 131 - protein, 10 aa, Stomoxys calcitrans
ATCDLLSMWN

SEQ ID NO: 132 - protein, 54 aa, Heuchera sanguinea
DGVKLCDVPSGTWSGHCGSSSKCSQQCKDREHFAYGGACHYQFPSVKCFCKRQC

SEQ ID NO: 133 - protein, 50 aa, Aesculus hippocastanum
LCNERPSQTWSGNCGNTAHCDKQCQDWEKASHGACHKRENHWKCFCYFNC

SEQ ID NO: 134 - protein, 49 aa, Clitoria ternatea
NLCERASLTWTGNCGNTGHCDTQCRNWESAKHGACHKRGNWKCFCYFNC

SEQ ID NO: 135 - protein, 44 aa, Archaeoprepona demophon
DKLIGSCVWGAVNYTSNCNAECKRRGYKGGHCGSFANVNCWCET

SEQ ID NO: 136 - protein, 43 aa, Zophobas atratus
FTCDVLGFEIAGTKLNSAACGAHCLALGRTGGYCNSKSVCVCR

SEQ ID NO: 137 - protein, 24 aa, Spinacia oleracea
  MOD_RES (8)..(8): Any amino acid
  MOD_RES (19)..(19): Any amino acid
  MOD_RES (22)..(23): Any amino acid
GIFSNMYXRTPAGYFRGPXGYXXN

SEQ ID NO: 138 - protein, 38 aa, Spinacia oleracea
GIFSSRKCKTPSKTFKGYCTRDSNCDTSCRYEGYPAGD

SEQ ID NO: 139 - protein, 48 aa, Capsicum annuum
KICEALSGNFKGLCLSSRDCGNVCRREGFTDGSCIGFRLQCFCTKPCA

SEQ ID NO: 140 - protein, 38 aa, Mytilus galloprovincialis
GFGCPNNYQCHRHCKSIPGRCGGYCGGWHRLRCTCYRC

SEQ ID NO: 141 - protein, 32 aa, Rattus norvegicus
VTCYCRRTRCGFRERLSGACGYRGRIYRLCCR

SEQ ID NO: 142 - protein, 9 aa, Oryctes rhinoceros
AHCLAIGRK

SEQ ID NO: 143 - protein, 46 aa, Stomoxys calcitrans
AAKPMGITCDLLSLWKVGHAACAAHCLVLGDVGGYCTKEGLCVCKE

SEQ ID NO: 144 - protein, 32 aa, Papio hamadryas
RICRCRIGRCLGLEVYFGVCFLHGRLARRCCR

SEQ ID NO: 145 - protein, 35 aa, Mus musculus
LRDLVCYCRSRGCKGRERMNGTCRKGHLLYTLCCR

SEQ ID NO: 146 - protein, 32 aa, Papio hamadryas
RTCRCRLGRCSRRESYSGSCNINGRIYSLCCR

SEQ ID NO: 147 - protein, 40 aa, Aedes aegypti
ATCDLLSGFGVGDSACAAHCIARGNRGGYCNSKKVCVCRN

SEQ ID NO: 148 - protein, 37 aa, Mytilus edulis
  MOD_RES (21)..(21): Any amino acid
  MOD_RES (28)..(28): Any amino acid
GFGCPNDYPCHRHCKSIPGRXGGYCGGXHRLRCTCYR

SEQ ID NO: 149 - protein, 43 aa, Anomala cuprea
VTCDLLSFEAKGFAANHSICAAHCLAIGRKGGSCQNGVCVCRN

SEQ ID NO: 150 - protein, 35 aa, Mytilus edulis
  MOD_RES (28)..(28): Any amino acid
GFGCPNDYPCHRHCKSIPGRYGGYCGGXHRLRCTC

SEQ ID NO: 151 - protein, 43 aa, Anomala cuprea
VTCDLLSFEAKGFAANHSICAAHCLVIGRKGGACQNGVCVCRN

SEQ ID NO: 152 - protein, 44 aa, Galleria mellonella
DKLIGSCVWGATNYTSDCNAECKRRGYKGGHCGSFWNVNCWCEE

SEQ ID NO: 153 - protein, 35 aa, Mus musculus
LRDLVCYCRSRGCKGRERMNGTCRKGHLMYTLCCR

SEQ ID NO: 154 - protein, 35 aa, Mus musculus
LRDLVCYCRTRGCKRRERMNGTCRKGHLMYTLCCR

SEQ ID NO: 155 - protein, 35 aa, Mus musculus
LRDLVCYCRKRGCKRRERMNGTCRKGHLMYTLCCR

SEQ ID NO: 156 - protein, 33 aa, Mus musculus
DLVCYCRARGCKGRERMNGTCRKGHLLYMLCCR

SEQ ID NO: 157 - protein, 29 aa, Phyllomedusa oreades
GLWSTIKQKGKEAAIAAAKAAGQAALGAL

SEQ ID NO: 158 - protein, 34 aa, Phyllomedusa sauvagii
ALWKTMLKKLGTMALHAGKAALGAAADTISQGTQ

SEQ ID NO: 159 - protein, 25 aa, Phyllomedusa hypochondrialis
GLWSTIKNVGKEAAIAAGKAALGAL

SEQ ID NO: 160 - protein, 34 aa, Phyllomedusa sauvagii
ALWFTMLKKLGTMALHAGKAALGAAANTISQGTQ

SEQ ID NO: 161 - protein, 30 aa, Phyllomedusa bicolor
ALWKTIIKGAGKMIGSLAKNLLGSQAQPES

SEQ ID NO: 162 - protein, 30 aa, Phyllomedusa sauvagii
ALWKNMLKGIGKLAGKAALGAVKKLVGAES

SEQ ID NO: 163 - protein, 27 aa, Phyllomedusa sauvagii
ALWMTLLKKVLKAAAKALNAVLVGANA

SEQ ID NO: 164 - protein, 29 aa, Phyllomedusa sauvagii
GLWSKIKTAGKSVAKAAAKAAVKAVTNAV

SEQ ID NO: 165 - protein, 28 aa, Phyllomedusa bicolor
ALWKNMLKGIGKLAGQAALGAVKTLVGA

SEQ ID NO: 166 - protein, 28 aa, Phyllomedusa bicolor
ALWKDILKNVGKAAGKAVLNTVTDMVNQ

SEQ ID NO: 167 - protein, 26 aa, Phyllomedusa bicolor
GLWNKIKEAASKAAGKAALGFVNEMV

SEQ ID NO: 168 - protein, 25 aa, Phyllomedusa azurea
GLWSTIKNVGKEAAIAAGKAALGAL

SEQ ID NO: 169 - protein, 25 aa, Phyllomedusa azurea
GLWSTIKNVGKEAAIAAGKAVLGSL

SEQ ID NO: 170 - protein, 26 aa, Phyllomedusa bicolor
GLVTSLIKGAGKLLGGLFGSVTGGQS

SEQ ID NO: 171 - protein, 47 aa, Homo sapiens
SSLLEKGLDGAKKAVGGLGKLGKDAVEDLESVGKGAVHDVKDVLDSV

SEQ ID NO: 172 - protein, 37 aa, Sarcophaga peregrina
DLHIPPPDNKINWPQLSGGGGGSPKTGYDININAQQK

SEQ ID NO: 173 - protein, 82 aa, Protophormia terraenovae
DEKPKLILPTPAPPNLPQLVGGGGGNRKDGFGVSVDAHQKVWTSDNGGHSIGVSPGYSQHLPGPYGNSRPDYRIGAGYSYNF

SEQ ID NO: 174 - protein, 50 aa, Dahlia merckii
ELCEKASKTWSGNCGNTGHCDNQCKSWEGAAHGACHVRNGKHMCFCYFNC

SEQ ID NO: 175 - protein, 19 aa, Drosophila melanogaster
GKPRPYSPRPTSHPRPIRV

SEQ ID NO: 176 - protein, 44 aa, Drosophila melanogaster
DCLSGRYKGPCAVWDNETCRRVCKEEGRSSGHCSPSLKCWCEGC

SEQ ID NO: 177 - protein, 33 aa, Rana dybowskii
GLFDVVKGVLKGVGKNVAGSLLEQLKCKLSGGC

SEQ ID NO: 178 - protein, 36 aa, Human immunodeficiency virus
YTSLIHSLIEESQNQQEKNEQELLELDKWASLWNWF

SEQ ID NO: 179 - protein, 29 aa, Bos taurus
FAEPLPSEEEGESYSKEVPEMEKRYGGFM

SEQ ID NO: 180 - protein, 47 aa, Petunia hybrida
ATCKAECPTWDSVCINKKPCVACCKKAKFSDGHCSKILRRCLCTKEC

SEQ ID NO: 181 - protein, 49 aa, Petunia hybrida
GTCKAECPTWEGICINKAPCVKCCKAQPEKFTDGHCSKILRRCLCTKPC

SEQ ID NO: 182 - protein, 47 aa, Nicotiana alata
RECKTESNTFPGICITKPPCRKACISEKFTDGHCSKILRRCLCTKPC

SEQ ID NO: 183 - protein, 42 aa, Gallus gallus
SPIHACRYQRGVCIPGPCRWPYYRVGSCGSGLKSCCVRNRWA

SEQ ID NO: 184 - protein, 61 aa, Anopheles gambiae
MVFAYAPTCARCKSIGARYCGYGYLNRKGVSCDGQTTINSCEDCKRKFGRCSDGFITECFF

SEQ ID NO: 185 - protein, 44 aa, Heliothis virescens
DKLIGSCVWGAVNYTSDCNGECKRRGYKGGHCGSFANVNCWCET

SEQ ID NO: 186 - protein, 38 aa, Macaca fascicularis
DSHEERHHGRHGHHKYGRKFHEKHHSHRGYRSNYLYDN

SEQ ID NO: 187 - protein, 38 aa, Homo sapiens
DSHEKRHHGYRRKFHEKHHSHREFPFYGDYGSNYLYDN

SEQ ID NO: 188 - protein, 32 aa, Homo sapiens
DSHAKRHHGYKRKFHEKHHSHRGYRSNYLYDN

SEQ ID NO: 189 - protein, 24 aa, Homo sapiens
DSHAKRHHGYKRKFHEKHHSHRGY

SEQ ID NO: 190 - protein, 32 aa, Homo sapiens
AFTCHCRRSCYSTEYSYGTCTVMGINHRFCCL

SEQ ID NO: 191 - protein, 39 aa, Homo sapiens
DPVTCLKSGAICHPVFCPRRYKQIGTCGLPGTKCCKKPP

SEQ ID NO: 192 - protein, 41 aa, Homo sapiens
GIGDPVTCLKSGAICHPVFCPRRYKQIGTCGLPGTKCCKKP

SEQ ID NO: 193 - protein, 48 aa, Homo sapiens
ELDRICGYGTARCRKKCRSQEYRIGRCPNTYACCLRKWDESLLNRTKP

SEQ ID NO: 194 - protein, 30 aa, Homo sapiens
ACYCRIPACIAGERRYGTCIYQGRLWAFCC

SEQ ID NO: 195 - protein, 32 aa, Homo sapiens
ATCYCRTGRCATRESLSGVCEISGRLYRLCCR

SEQ ID NO: 196 - protein, 11 aa, Homo sapiens
FQWQRNMRKVR

SEQ ID NO: 197 - protein, 13 aa, Artificial Sequence
  Description of Artificial Sequence: Synthetic anti-microbial peptide
  MOD_RES (13)..(13): Any amino acid
ILPWKWPWWPWRX

SEQ ID NO: 198 - protein, 13 aa, Bos taurus
ILPWKWPWWPWRR

SEQ ID NO: 199 - protein, 13 aa, Artificial Sequence
  Description of Artificial Sequence: Synthetic anti-microbial peptide
  MOD_RES (13)..(13): Any amino acid
ILAWKWAWWAWRX

SEQ ID NO: 200 - protein, 25 aa, Bos taurus
FKCRRWQWRMKKLGAPSITCVRRAF

SEQ ID NO: 201 - protein, 26 aa, Drosophila melanogaster
HRHQGPIFDTRPSPFNPNQPRPGPIY

SEQ ID NO: 202 - protein, 25 aa, Drosophila melanogaster
RRQGPIFDTRPSPFNPNQPRPGPIY

SEQ ID NO: 203 - protein, 9 aa, Artificial Sequence
  Description of Artificial Sequence: Synthetic anti-microbial peptide
ALRLAIRKR

SEQ ID NO: 204 - protein, 9 aa, Artificial Sequence
  Description of Artificial Sequence: Synthetic anti-microbial peptide
ALLLAIRKR

SEQ ID NO: 205 - protein, 9 aa, Artificial Sequence
  Description of Artificial Sequence: Synthetic anti-microbial peptide
AWLLAIRKR

SEQ ID NO: 206 - protein, 9 aa, Artificial Sequence
  Description of Artificial Sequence: Synthetic anti-microbial peptide
ALYLAIRKR

SEQ ID NO: 207 - protein, 9 aa, Artificial Sequence
  Description of Artificial Sequence: Synthetic anti-microbial peptide
ALWLAIRKR

SEQ ID NO: 208 - protein, 43 aa, Galleria mellonella
GKIPVKAIKKGGQIIGKALRGINIASTAHDIISQFKPKKKKNH

SEQ ID NO: 209 - protein, 23 aa, Morone chrysops
FFHHIFRGIVHVGKTIHKLVTGG

SEQ ID NO: 210 - protein, 23 aa, Morone saxatilis
FFHHIFRGIVHVGKTIHRLVTGG

SEQ ID NO: 211 - protein, 23 aa, Morone chrysops
FFHHIFRGIVHVGRTIHKLVTGG

SEQ ID NO: 212 - protein, 23 aa, Morone saxatilis
FFHHIFRGIVHVGRTIHRLVTGG

SEQ ID NO: 213 - protein, 22 aa, Morone chrysops
FFHHIFRGIVHVGKTIHKLVTG

SEQ ID NO: 214 - protein, 22 aa, Siniperca chuatsi
IFHHIFKGIVHVGKTIHRLVTG

SEQ ID NO: 215 - protein, 22 aa, Morone saxatilis
FFHHIFRGIVHVGKTIHRLVTG

SEQ ID NO: 216 - protein, 32 aa, Rattus norvegicus
VTCYCRSTRCGFRERLSGACGYRGRIYRLCCR

SEQ ID NO: 217 - protein, 29 aa, Rattus norvegicus
CSCRTSSCRFGERLSGACRLNGRIYRLCC

SEQ ID NO: 218 - protein, 31 aa, Rattus norvegicus
ACYCRIGACVSGERLTGACGLNGRIYRLCCR

SEQ ID NO: 219 - protein, 41 aa, Bos taurus
QRVRNPQSCRWNMGVCIPFLCRVGMRQIGTCFGPRVPCCRR

SEQ ID NO: 220 - protein, 28 aa, Bos taurus
NPQSCRWNMGVCIPISCPGNMRQIGTCS

SEQ ID NO: 221 - protein, 33 aa, Mesocricetus auratus
VTCFCRRRGCASRERHIGYCRFGNTIYRLCCRR

SEQ ID NO: 222 - protein, 30 aa, Macaca mulatta
ACYCRIPACLAGERRYGTCFYLGRVWAFCC

SEQ ID NO: 223 - protein, 31 aa, Mesocricetus auratus
CFCKRPVCDSGETQIGYCRLGNTFYRLCCRQ

SEQ ID NO: 224 - protein, 30 aa, Macaca mulatta
ACYCRIPACLAGERRYGTCFYMGRVWAFCC

SEQ ID NO: 225 - protein, 30 aa, Homo sapiens
DCYCRIPACIAGERRYGTCIYQGRLWAFCC

SEQ ID NO: 226 - protein, 33 aa, Mesocricetus auratus
VTCFCRRRGCASRERLIGYCRFGNTIYGLCCRR

SEQ ID NO: 227 - protein, 30 aa, Macaca mulatta
ACYCRIPACLAGERRYGTCFYRRRVWAFCC

SEQ ID NO: 228 - protein, 33 aa, Macaca mulatta
RRTCRCRFGRCFRRESYSGSCNINGRIFSLCCR

SEQ ID NO: 229 - protein, 33 aa, Mesocricetus auratus
VTCFCKRPVCDSGETQIGYCRLGNTFYRLCCRQ

SEQ ID NO: 230 - protein, 33 aa, Pan troglodytes
VCSCRLVFCRRTELRVGNCLIGGVSFTYCCTRV

SEQ ID NO: 231 - protein, 33 aa, Macaca mulatta
RRTCRCRFGRCFRRESYSGSCNINGRISSLCCR

SEQ ID NO: 232 - protein, 30 aa, Macaca mulatta
ACYCRIPACLAGERRYGTCFYLRRVWAFCC

SEQ ID NO: 233 - protein, 33 aa, Odorrana grahami
GVLGTVKNLLIGAGKSAAQSVLKTLSCKLSNDC

SEQ ID NO: 234 - protein, 32 aa, Macaca mulatta
RRTCHCRSRCLRRESNSGSCNINGRIFSLCCR

SEQ ID NO: 235 - protein, 47 aa, Litopenaeus setiferus
HSSGYTRPLRKPSRPIFIRPIGCDVCYGIPSSTARLCCFRYGDCCHL

SEQ ID NO: 236 - protein, 60 aa, Fenneropenaeus chinensis
QGYKSGHTGPYPRPLYGSRPIGLRPITRPDPSCAGCRILTLDDAIACCRRLGRCCSALKG

SEQ ID NO: 237 - protein, 31 aa, Litopenaeus vannamei
YRGGYTGPIPRPPPIGRPPLRLVVCACYRLS

SEQ ID NO: 238 - protein, 50 aa, Litopenaeus vannamei
YRGGYTGPIPRPPPIGRPPFRPVCNACYRLSVSDARNCCIKFGSCCHLVK

SEQ ID NO: 239 - protein, 62 aa, Litopenaeus vannamei
QVYKGGYTRPIPRPPPFVRPLPGGPIGPYNGCPVSCRGISFSQARSCCSRLGRCCHVGKGYS

SEQ ID NO: 240 - protein, 40 aa, Phormia terranovae
ATCDLLSGTGINHSACAAHCLLRGNRGGYCNRKGVCVCRN

SEQ ID NO: 241 - protein, 20 aa, Protophormia terraenovae
ACAAHCLLRGNRGGYCNGKG

SEQ ID NO: 242 - protein, 25 aa, Pseudopleuronectes americanus
GWGSFFKKAAHVGKHVGKAALTHYL

SEQ ID NO: 243 - protein, 26 aa, Hippoglossoides platessoides
GWKSVFRKAKKVGKTVGGLALDHYLG

SEQ ID NO: 244 - protein, 26 aa, Hippoglossoides platessoides
GWKKWFNRAKKVGKTVGGLAVDHYLG

SEQ ID NO: 245 - protein, 23 aa, Hippoglossoides platessoides
GWRTLLKKAEVKTVGKLALKHYL

SEQ ID NO: 246 - protein, 18 aa, Glyptocephalus cynoglossus
GWKKWFTKGERLSQRHFA

SEQ ID NO: 247 - protein, 21 aa, Glyptocephalus cynoglossus
FWGKLLKLGMHGIGLLHQHLG

SEQ ID NO: 248 - protein, 26 aa, Glyptocephalus cynoglossus
GWGSIFKHIFKAGKFIHGAIQAHNDG

SEQ ID NO: 249 - protein, 26 aa, Hippoglossus hippoglossus
GFLGILFHGVHHGRKKALQMNSERRS

SEQ ID NO: 250 - protein, 24 aa, Hippoglossus hippoglossus
FLGLLFHGVHHVGKWIHGLIHGHH

SEQ ID NO: 251 - protein, 21 aa, Pseudopleuronectes americanus
RSTEDIIKSISGGGFLNAMNA

SEQ ID NO: 252 - protein, 25 aa, Limanda ferruginea
RWGKWFKKATHVGKHVGKAALTAYL

SEQ ID NO: 253 - protein, 29 aa, Bos taurus
FAEPTBSEEEGESYSKEVPEMEKRYGGFM

SEQ ID NO: 254 - protein, 18 aa, Sus scrofa
RGGRLCYCRRRFCVCVGR

SEQ ID NO: 255 - protein, 16 aa, Sus scrofa
RGGRLCYCRRRFCICV

SEQ ID NO: 256 - protein, 18 aa, Sus scrofa
RGGGLCYCRRRFCVCVGR

SEQ ID NO: 257 - protein, 20 aa, Pyrrhocoris apterus
VDKGSYLPRPTPPRPIYNRN

SEQ ID NO: 258 - protein, 33 aa, Rana temporaria
GLLSGLKKVGKHVAKNVAVSLMDSLKCKISGDC

SEQ ID NO: 259 - protein, 43 aa, Crassostrea gigas
GFGCPGNQLKCNNHCKSISCRAGYCDAATLWLRCTCTDCNGKK

SEQ ID NO: 260 - protein, 36 aa, Caretta caretta
EKKCPGRCTLKCGKHERPTLPYNCGKYICCVPVKVK

SEQ ID NO: 261 - protein, 18 aa, Macaca mulatta
GFCRCICTRGFCRCICTR

SEQ ID NO: 262 - protein, 128 aa, Homo sapiens
KPKGMTSSQWFKIQHMQPSPQACNSAMKNINKHTKRCKDLNTFLHEPFSSVAATCQTPKIACKNGDKNCHQSHGAVSLTMCKLTSGKHPNCRYKEKRQNKSYVVACKPPQKKDSQQFHLVPVHLDRVL

SEQ ID NO: 263 - protein, 51 aa, Apis mellifera
VTCDLLSFKGQVNDSACAANCLSLGKAGGHCEKVGCICRKTSFKDLWDKYF

SEQ ID NO: 264 - protein, 24 aa, Haemaphysalis longicornis
NCIQQCVSKGAQGGYCTNEKCTCY

SEQ ID NO: 265 - protein, 28 aa, Capsella bursa-pastoris
GYGGHGGHGGHGGHGGHGGHGHGGGGHG

SEQ ID NO: 266 - protein, 38 aa, Capsella bursa-pastoris
GYHGGHGGHGGGYNGGGGHGGHGGGYNGGGHHGGGGHG

SEQ ID NO: 267 - protein, 20 aa, Styela clava
  MOD_RES (2)..(2): Any amino acid
  MOD_RES (8)..(8): Any amino acid
GXFGKAFXSVSNFAKKHKTA

SEQ ID NO: 268 - protein, 31 aa, Styela clava
GWFGKAFRSVSNFYKKHKTYIHAGLSAATLL

SEQ ID NO: 269 - protein, 32 aa, Styela clava
GWLRKAAKSVGKFYYKHKYYIKAAWQIGKHAL

SEQ ID NO: 270 - protein, 73 aa, Tachypleus tridentatus
YLAFRCGRYSPCLDDGPNVNLYSCCSFYNCHKCLARLENCPKGLHYNAYLKVCDWPSKAGCTSVNKECHLWKT

SEQ ID NO: 271 - protein, 17 aa, Tachypleus tridentatus
KWCFRVCYRGICYRRCR

SEQ ID NO: 272 - protein, 17 aa, Tachypleus tridentatus
RWCFRVCYRGICYRKCR

SEQ ID NO: 273 - protein, 17 aa, Tachypleus gigas
KWCFRVCYRGICYRKCR

SEQ ID NO: 274 - protein, 21 aa, Podisus maculiventris
GSKKPVPIIYCNRRTGKCQRM

SEQ ID NO: 275 - protein, 13 aa, Sus scrofa
VRRFPWWWPFLRR

SEQ ID NO: 276 - protein, 47 aa, Phaseolus vulgaris
KTCENLADTFRGPCFATSNCDDHCKNKEHLLSGRCRDDFRCWCTRNC

SEQ ID NO: 277 - protein, 14 aa, Artificial Sequence
  Description of Artificial Sequence: Synthetic anti-microbial peptide
  MOD_RES (14)..(14): Any amino acid
ALWKTLLKKVLKAX

SEQ ID NO: 278 - protein, 18 aa, Artificial Sequence
  Description of Artificial Sequence: Synthetic anti-microbial peptide
ALYKKFKKKLLKSLKRLG

SEQ ID NO: 279 - protein, 257 aa, Rhodococcus sp.
  RHA1
NLHRNLAPVTEVAWQQIGEEAARTFKRHVAGRRVVDVAGPFGYSYSAHNLGRVTPIKTSDSRIRAQQRQVNPLVELRFPFTLSRAEVDDVARGSLDSDWQPVKDAAKAVAFAEDQSIFQGFDEAGIRGLGPSSDNPVLSLPEDPLLIPDAVASALSALRLAGVEGPYSVVLDADAYTAVSETRDEGHPVFHHLRDLVAGDIIWAPAISGGYVLSTRGGDNQLTLGTDLSIGYDSHTATDVTLYLEETFTFASLTAEA

SEQ ID NO: 280 - protein, 36 aa, Bos taurus
NPQSCRWNMGVCIPISCPGNMRQIGTCFGPRVPCCR

SEQ ID NO: 281 - protein, 15 aa, Rana sakuraii
FLPMLAKLLSGFLGK

SEQ ID NO: 282 - protein, 16 aa, Rana sakuraii
RLPPGFTPWRIAPAIV

SEQ ID NO: 283 - protein, 32 aa, Bos taurus
NPQSCRWNMGVCIPISFLVNMRQIGTCFGPRV

SEQ ID NO: 284 - protein, 182 aa, Pichia stipitis
  CBS 6054
RVGDLPPAIRQELEEFDRYINKQHLVATTLQADYGKHDQLINTIPKDINYLHNKLMSTKQALKFDSGQLVHLKELNNEITDDISKIMQLILQLSTPGTRLSSSFQLNEFFVKKIKKYYEILRQYEGVVAELDSILGGLERSCTEGFGNLFNIVEVIKSQYHLFMELCETMAQLHNEVNKLSK

SEQ ID NO: 285 - protein, 75 aa, Ciona intestinalis
ALRGALRAVARVGKAILPHVAIANPYVRTPYVHNNPDWSLWRSRRRSGNQQPTSQAEILEDALEAQAIEALMQEQ

SEQ ID NO: 286 - protein, 73 aa, Ciona intestinalis
ALRSAVRTVARVGRAVLPHVAIADPYVRTPYVHNNPDWSLWRRKRWNQQPTSQADMLEDALEAQAIEALMQEQ

SEQ ID NO: 287 - protein, 259 aa, Burkholderia multivorans
  ATCC 17616
MNNLHRELAPISSAAWEQIEEEVARTFKRSVAGRRVVDVEGPKGPELSAVGTGHLRDVAAPREHVDARLREVRTIVELTVPFELDRAAIDSVERGARDADWQAAKEAAQRLAFAEDSAIFDGYPAAGIVGIREGTSNRKLTLPSDVGAYPDAISDALEALRLAGVDGPYSVLLGADAYTALSEARDQGYPVIEHIKRIVSGEIIWAPAISGGCVLSTRGGDYELHLGEDVSIGYASHTDKVVRLYLRETLTFLMLTSEA

SEQ ID NO: 288 - protein, 67 aa, Bos taurus
ALSYREAVLRAVDRINERSSEANLYRLLELDPPPKDVEDRGARKPTSFTVKETVCPRTSPQPPEQCD

SEQ ID NO: 289 - protein, 36 aa, Bos taurus
NPVSCVRNKGICVPIRCPGSMKQIGTCVGRAVKCCR

SEQ ID NO: 290 - protein, 253 aa, Sorangium cellulosum
  'So ce 56'
MDLLKRELAPILPAAWDLIDHEATRVLKLHLAGRKVVDFRGPFGWEVAAVNTGRLRAIERKEGPAVSAGVRLVRPLVEFRAPIRLELAELDAVGRGAQEPNIEDVVRAAEHAARFEDGAIFNGLAAAGIEGILEVAPHKPVVIPAPEAWPRAVAEAREVLRAAGVDGPYALALGPKAYDELAAAAEDGYPLRKHIEGQLIDGPIVWAPALEGGVLLSTRGGDFELTVGEDLSIGYDGHDRQVVELFLTESFTF

SEQ ID NO: 291 - protein, 19 aa, Helicobacter pylori
AKKVFKRLEKLFSKIQNDK

SEQ ID NO: 292 - protein, 66 aa, Caenorhabditis elegans
EASCARMDVPVMQRIAQGLCTSSCTAQKCMTGICKKVDSHPTCFCGGCSNANDVSLDTLISQLPHN

SEQ ID NO: 293 - protein, 67 aa, Caenorhabditis elegans
DIDFSTCARMDVPILKKAAQGLCITSCSMQNCGTGSCKKRSGRPTCVCYRCANGGGDIPLGALIKRG

SEQ ID NO: 294 - protein, 132 aa, Acanthoscurria gomesiana
DVYKGGGGGRYGGGRYGGGGGYGGGLGGGGLGGGGLGGGKGLGGGGLGGGGLGGGGLGGGGLGGGKGLGGGGLGGGGLGGGGLGGGGLGGGKGLGGGGLGGGGLGGGRGGGYGGGGGYGGGYGGGYGGGKYK

SEQ ID NO: 295 - protein, 131 aa, Acanthoscurria gomesiana
DVYKGGGGGRYGGGRYGGGGGYGGGLGGGGLGGGGLGGGKGLGGGGLGGGGLGGGGLGGGGLGGGKGLGGGGLGGGGLGGGGLGGGGLGGGKGLGGGGLGGGGLGGGRGGYGGGGYGGGYGGGYGGGKYKG

SEQ ID NO: 296 - protein, 50 aa, Mesobuthus martensii
YPASMDNYDDALEELDNLDLDDYFDLEPADFVLLDMWANMLESSDFDDME

SEQ ID NO: 297 - protein, 108 aa, Streptomyces globisporus
APAFSVSPASGASDGQSVSVSVAAAGETYYIAQCAPVGGQDACNPATATSFTTDASGAASFSFTVRKSYAGQTPSGTPVGSVDCATDACNLGAGNSGLNLGHVALTFG

SEQ ID NO: 298 - protein, 15 aa, Agrocybe cylindracea
ANDPQCLYGNVAAKF

SEQ ID NO: 299 - protein, 10 aa, Allium sativum
DDFLCAGGCL

SEQ ID NO: 300 - protein, 13 aa, Calliphora vicina
HGVSGHGQHGVHG

SEQ ID NO: 301 - protein, 20 aa, Basella alba
GADFQECMKEHSQKQHQHQG

SEQ ID NO: 302 - protein, 27 aa, Benincasa hispida
RDWERREFERRQNELRREQEQRREELL

SEQ ID NO: 303 - protein, 9 aa, Polyporus alveolaris
GVCDMADLA

SEQ ID NO: 304 - protein, 81 aa, Salinispora arenicola
  CNS-205
PRITIDRVVLARESWRFTVTGLGFATLTGQGDRFRRVQRWQHAHGLPRHLFGWTPMEERPFSLDLTSPASVDVLAGALRRT

SEQ ID NO: 305 - protein, 24 aa, Amolops loloensis
FLPMLAGLAANFLPKLFCKITKKC

SEQ ID NO: 306 - protein, 24 aa, Amolops loloensis
FLPMLAGLAANFLPKLFCKITKKC

SEQ ID NO: 307 - protein, 24 aa, Amolops loloensis
FLPLAVSLAANFLPKLFCKITKKC

SEQ ID NO: 308 - protein, 24 aa, Amolops loloensis
FLPMLAGLAANLLPKLFCKITKKC

SEQ ID NO: 309 - protein, 24 aa, Amolops loloensis
FLPMLAGLAANFLPELFCKITKKC

SEQ ID NO: 310 - protein, 16 aa, Amolops loloensis
FLPIVGKLLSGLSGLL

SEQ ID NO: 311 - protein, 13 aa, Amolops loloensis
FLPIVGKLLSGLL

SEQ ID NO: 312 - protein, 13 aa, Amolops loloensis
LLPIVGKLLSGLL

SEQ ID NO: 313 - protein, 64 aa, Amolops loloensis
MFTMKKSLLLLFFLGTIHLSLCEQERNAEEERRDDLGERQAEVEKRFLPIAGKLLSGLSGLLGK

SEQ ID NO: 314 - protein, 64 aa, Amolops loloensis
MFTLKKSLLLLFFLGTINLSLCEQERNAEEERRDEPDERNAEVEKRFFPIVGKLLFGLSGLLGK

SEQ ID NO: 315 - protein, 64 aa, Amolops loloensis
MFTLKKSLLLLFFLGTINLSLCEQERNAEEERRDEPDERNAEVEKRFFPIVGKLLSGLSGLLGK

SEQ ID NO: 316 - protein, 64 aa, Amolops loloensis
MFTLKKSLLLLFFLGTINLSLCEQERNAEEERRDDLGERQAEVEKRFFPIVGKLLFGLFGLLGK

SEQ ID NO: 317 - protein, 61 aa, Amolops loloensis
MFPLKKSLLLLFFLATINLSLCEQERNAEEERRDEPDERNAEVEKRFFPIVGKLLSGLLGK

SEQ ID NO: 318 - protein, 61 aa, Amolops loloensis
MFTLKKSLLLLFFLATINLSFCEQERNAEEERRDEPDERNAEVEKRFFPIVGKLLFGLLGK

SEQ ID NO: 319 - protein, 14 aa, Amolops loloensis
FLPPSPWKETFRTT

SEQ ID NO: 320 - protein, 61 aa, Amolops loloensis
MFTMKKSLLLLFFLGAISLSLCEQERDADEEETEGGAKVETVKRASVPPGFTPFRVAPEIV

SEQ ID NO: 321 - protein, 66 aa, Amolops loloensis
MFTMKKSLLLLFFLGMISLSLCKQERDANEERRDDPDENEENGGEAKVEEIKRAARPPLGCKAAFC

SEQ ID NO: 322 - protein, 66 aa, Amolops loloensis
MFTMKKSLLLLFFLGMISLSLCKQERDANEERRDDPDENEENGGEAKVEEIKRAARPPLRCKAAFC

SEQ ID NO: 323 - protein, 63 aa, Amolops loloensis
MFTMKKSLLLLFFLGAISLSLCEQERDADEEDGGEVTEEEVKRAAFRGCWTKNYSPKPCLGKR

SEQ ID NO: 324 - protein, 66 aa, Amolops loloensis
MFTMKKSLLLLFFLGMISLSLCKQERDANEERRDDPDENEENGGEAKVEEIQRGARPPLRCKAALC

SEQ ID NO: 325 - protein, 76 aa, Amolops loloensis
MFTLKKSMLLLFFLGTISLSLCEEERNADEDDGEKEVKRGIFALIKTAAKFVGKNLLKQAGKAGLEHLACKANNQC

SEQ ID NO: 326 - protein, 76 aa, Amolops loloensis
MFTMKKSLLLLFFLGTISLSLCEEERSADEDDGEKGVKRGIFSLIKTAAKFVGKNLLKQAGKAGVEHLACKANNQC

SEQ ID NO: 327 - protein, 57 aa, Amolops loloensis
MFTLKKSLLLLFFLGTINLSLCEQERNAEEERRDDLGERQAEVEKRFFPIVGKLLSG

SEQ ID NO: 328 - protein, 45 aa, Amolops loloensis
FTMKKSLLLLFFLGTINLSLCEQERNAEEERRDDLGERQAEVEKR

SEQ ID NO: 329 - protein, 62 aa, Amolops loloensis
MFPMKKSLLLLFFFGPISLSFCDQERGADEEENGGEVTEQEVKRNILSSIVNGINRALSFFG

SEQ ID NO: 330 - protein, 62 aa, Amolops loloensis
MFTLKKSLLLLFFLGTISLSLCEQERGADEEENGGEVTEQEVKRNVLSSVANGINRALSFFG

SEQ ID NO: 331 - protein, 60 aa, Galleria mellonella
ETESTPDYLKNIQQQLEEYTKNFNTQVQNAFDSDKIKSEVNNFIESLGKILNTEKKEAPK

SEQ ID NO: 332 - protein, 50 aa, Tityus costatus
YPASYDGDFDALDDLDDLDLDDLLDLEPADLVLLDMWANMLDSQDFEDFE

SEQ ID NO: 333 - protein, 50 aa, Tityus costatus
YPTSYDDDFDALDDLDDLDLDDLLDLEPADLVLLDMWANMLDSQDFEDFE

SEQ ID NO: 334 - protein, 50 aa, Tityus costatus
YPASYDDDFDALDDLDDLDLDDLLDLEPADLVLLDMWANMLDSQDFEDFE

SEQ ID NO: 335 - protein, 50 aa, Tityus costatus
YPASYDDDFDALDDLDGLDLDDLLDSEPADLVLLDMWANMLDSQDFEDFE

SEQ ID NO: 336 - protein, 20 aa, Rana huanrenensis
FLSLALAALPKFLCLVFKKC

SEQ ID NO: 337 - protein, 60 aa, Rana chensinensis
MFTLKKSLLLLFFLGTINLSLCEEERNADEERRDDPEERAVEVEKRILPILSLIGGLLGK

SEQ ID NO: 338 - protein, 27 aa, Bos taurus
GRFKRFRKKFKKLFKKLSPVIPLLHLG

SEQ ID NO: 339 - protein, 34 aa, Bos taurus
GLFRRLRDSIRRGQQKILEKARRIGERIKDIFRG

SEQ ID NO: 340 - protein, 21 aa, Rana chensinensis
FTMKKSLLLLFFLGTINFSLC

SEQ ID NO: 341 - protein, 59 aa, Rana chensinensis
MFTLKKSLLLLFFLGTISLSLCEEERNAEEERRDYPEERDVEVEKRIIPLPLGYFAKKT

SEQ ID NO: 342 - protein, 18 aa, Artificial Sequence
  Description of Artificial Sequence: Synthetic anti-microbial peptide
RRWQWRGIGKFLHSAKKF

SEQ ID NO: 343 - protein, 44 aa, Staphylococcus aureus
  subsp. aureus USA300_FPR375
MTGLAEAIANTVQAAQQHDSVKLGTSIVDIVANGVGLLGKLFGF

SEQ ID NO: 344 - protein, 44 aa, Staphylococcus aureus
  subsp. aureus COL
MEGLFNAIKDTVTAAINNDGAKLGTSIVSIVENGVGLLGKLFGF

SEQ ID NO: 345 - protein, 44 aa, Staphylococcus aureus; identical to SEQ ID NO: 343
  subsp. aureus COL

SEQ ID NO: 346 - protein, 10 aa, Phaseolus vulgaris
SNDIYFNFQR

SEQ ID NO: 347 - protein, 41 aa, Eucommia ulmoides
QTCASRCPRPCNAGLCCSIYGYCGSGNAYCGAGNCRCQCRG

SEQ ID NO: 348 - protein, 41 aa, Eucommia ulmoides
QTCASRCPRPCNAGLCCSIYGYCGSGAAYCGAGNCRCQCRG

SEQ ID NO: 349 - protein, 76 aa, Galleria mellonella
MKIAFIVAISLAFLAVTSCIEFEKSTESHDIQKRGVTITVKPPFPGCVFYECIANCRSRGYKNGGYCTINGCQCLR

SEQ ID NO: 350 - protein, 206 aa, Zea mays
AVFTVVNQCPFTVWAASVPVGGGRQLNRGESWRITAPAGTTAARIWARTGCQFDASGRGSCRTGDCGGVVQCTGYGRAPNTLAEYALKQFNNLDFFDISILDGFNVPYSFLPDGGSGCSRGPRCAVDVNARCPAELRQDGVCNNACPVFKKDEYCCVGSAANNCHPTNYSRYFKGQCPDAYSYPKDDATSTFTCPAGTNYKVVFCP

SEQ ID NO: 351 - protein, 67 aa, Sarcophaga peregrina
QHGHGGQDQHGYGHGQQAVYGKGHEGHGVNNLGQDGHGQHGYAHGHSDQHGHGGQHGQHDGYKNRGY

SEQ ID NO: 352 - protein, 20 aa, Cullen corylifolium
EWEPVQNGGSSYYMVPRIWA

SEQ ID NO: 353 - protein, 87 aa, Streptomyces tendae
  MOD_RES (1)..(1): Any amino acid
  MOD_RES (87)..(87): Any amino acid
XINRTDCNENSYLEIHNNEGRDTLCFANAGTMPVAIYGVNWVESGNNVVTLQFQRNLSDPRLETITLQKWGSWNPGHIHEILSIRIX

SEQ ID NO: 354 - protein, 15 aa, Malva parviflora
PEDPQRRYQEEQRRE

SEQ ID NO: 355 - protein, 37 aa, Malva parviflora
  MOD_RES (20)..(20): Any amino acid
  MOD_RES (32)..(32): Any amino acid
  MOD_RES (34)..(34): Any amino acid
DRQIDMEEQQLEKLNKQDRXPGLRYAAKQQMXTXRMG

SEQ ID NO: 356 - protein, 46 aa, Beta vulgaris
AICKKPSKFFKGACGRDADCEKACDQENWPGGVCVPFLRCECQRSC

SEQ ID NO: 357 - protein, 46 aa, Beta vulgaris
ATCRKPSMYFSGACFSDTNCQKACNREDWPNGKCLVGFKCECQRPC

SEQ ID NO: 358 - protein, 51 aa, Aspergillus giganteus
  MOD_RES (1)..(1): Any amino acid
XTYNGKCYKKDNICKYKAQSGKTAICKCYVKKCPRDGAKCEFDSYKGKCYC

SEQ ID NO: 359 - protein, 10 aa, Cocos nucifera
EQCREEEDDR

SEQ ID NO: 360 - protein, 20 aa, Solanum tuberosum
LPSDATLVLDQTGKELDARL

SEQ ID NO: 361 - protein, 45 aa, Medicago sativa
RTCENLADKYRGPCFSGCDTHCTTKENAVSGRCRDDFRCWCTKRC

SEQ ID NO: 362 - protein, 44 aa, Hordeum vulgare
ATITVVNRCSYTVWPGALPGGGVRLDPGQRWALNMPAGTAGAAV

SEQ ID NO: 363 - protein, 37 aa, Hordeum vulgare
  MOD_RES (35)..(36): Any amino acid
ATFTVINKCQYTVWAAAVPAGGGQKLDAGQTWSIXXP

SEQ ID NO: 364 - protein, 93 aa, Tribolium castaneum
MSTKIFVLFALMCFVQVMAAPEPINWRKVGRRSWKITREALPVVKDGVEIYTLLNQQQPYYPYQQPPPPYYYGYPYPNPQGYQYGPPVHNYGY

SEQ ID NO: 365 - protein, 90 aa, Tribolium castaneum
MSTKLFVLFAFVCVVQVMAAPKPINWSQLGRNALDFGRKAVPVVKNGCQLLNGAPPPPQIYYVNVPYQNPQGGIPIQYAPPVSNNIEEIE

SEQ ID NO: 366 - protein, 49 aa, Aspergillus clavatus
TYDGKCYKKDNICKYKAQSGKTAICKCYVKVCPRDGAKCEFDSYKGKCY

SEQ ID NO: 367 - protein, 38 aa, Mesembryanthemum crystallinum
AKCIKNGKGCREDQGPPFCCSGFCYRQVGWARGYCKNR

SEQ ID NO: 368 - protein, 66 aa, Pheretima tschiliensis
MYSKYERQKDKRPYSERKDQYTGPQFLYPPDRIPPSKAIKWNEEGLPMYEVLPDGAGAKTAVEAAE

SEQ ID NO: 369 - protein, 37 aa, Mirabilis jalapa
QCIGNGGRCNENVGPPYCCSGFCLRQPGQGYGYCKNR

SEQ ID NO: 370 - protein, 79 aa, Pinus monticola
SYFSAWAGPGCNNHNARYSKCGCSNIGHNVHGGYEFVYQGQTAAAYNTDNCKGVAQTRFSSSVNQACSNFGWKSVFIQC

SEQ ID NO: 371 - protein, 27 aa, Xenopus tropicalis
GFLGPLLKLAAKGVAKVIPHLIPSRQQ

SEQ ID NO: 372 - protein, 76 aa, Macadamia integrifolia
SAFTVWSGPGCNNRAERYSKCGCSAIHQKGGYDFSYTGQTAALYNQAGCSGVAHTRFGSSARACNPFGWKSIFIQC

SEQ ID NO: 373 - protein, 38 aa, Phytolacca americana
AGCIKNGGRCNASAGPPYCCSSYCFQIAGQSYGVCKNR

SEQ ID NO: 374 - protein, 36 aa, Mirabilis jalapa
CIGNGGRCNENVGPPYCCSGFCLRQPNQGYGVCRNR

SEQ ID NO: 375 - protein, 79 aa, Pinus sylvestris
SYFTAWAGPGCNNHAARYSKCGCSNIGNNVHGGYEFMYQGQTAAAYNTDNCKGVAQTRFSSSVNQACSSFGWKSFFIQC

SEQ ID NO: 376 - protein, 22 aa, Xenopus tropicalis
GVFLDALKKFAKGGMNAVLNPK

SEQ ID NO: 377 - protein, 22 aa, Xenopus tropicalis
GMATKAGTALGKVAKAVIGAAL

SEQ ID NO: 378 - protein, 18 aa, Xenopus tropicalis
GFLGSLLKTGLKVGSNLL

SEQ ID NO: 379 - protein, 18 aa, Xenopus tropicalis
GLLGPLLKIAAKVGSNLL

SEQ ID NO: 380 - protein, 34 aa, Acrocinus longimanus
CIKNGNGCQPDGSQGNCCSRYCHKEPGWVAGYCR

SEQ ID NO: 381 - protein, 34 aa, Acrocinus longimanus
CIANRNGCQPDGSQGNCCSGYCHKEPGWVAGYCR

SEQ ID NO: 382 - protein, 36 aa, Acrocinus longimanus
CIKNGNGCQPNGSQGNCCSGYCHKQPGWVAGYCRRK

SEQ ID NO: 383 - protein, 30 aa, Amaranthus retroflexus
AGECVQGRCPSGMCCSQFGYCGRGPKYCGR

SEQ ID NO: 384 - protein, 208 aa, Glossina morsitans
MQSFKICFFISCLSVVLVKGQFGGTVSSNPNGGLDVNARLSKTIGDPNANVVGGVFAAGNTDGGPATRGAFLAANKDGHGLSLQHSKTDNFGSSLTSSAHAHLFNDKTHKLDANAFHSRTHLDNGFKFDRVGGGLRYDHVTGHGASLTASRIPQLDMNTLGLTGKANLWSSPNRATTLDLTGGVSKHFGGPFDGQTNKQIGLGLNSRF

SEQ ID NO: 385 - protein, 76 aa, Bos taurus
QAEESNLQSLVSQYFQTVADYGKDLVEKAKGSELQTQAKAYFEKTQEELTPFFKKAGTDLLNFLSSFIDPKKQPAT

SEQ ID NO: 386 - protein, 24 aa, Rana grahami
FFPLIAGLAANFLPQILCKIARKC

SEQ ID NO: 387 - protein, 66 aa, Plutella xylostella
MKLSNIFFFVFMAFFAVASVSAAPRWKPFKKLEKVGRNIRNGIIRYNGPAVAVIGQATSIARPTGK

SEQ ID NO: 388 - protein, 101 aa, Nasonia vitripennis
MKLLLVVAFIAVAVTAGLSIPLNEFEDLVDFQDWDEAAVDEDAGVRQRRVTCDLLSFGGVVGDSACAANCLSMGKAGGSCNGGICECRKTTFKELWDQRFG

SEQ ID NO: 389 - protein, 33 aa, Nasonia vitripennis
SFGGVVGDSACAANCLSMGKAGGSCNGGICECR

SEQ ID NO: 390 - protein, 101 aa, Nasonia vitripennis
MKFLIIAVFSAMVVSAALSLPLDELEDLVDVQDWEEAVVDDNAGIRQRRVTCDLLSFGGKVGHSACAANCLSMGKAGGRCNGGVCQCRKTTFGDLWNKRFG

SEQ ID NO: 391 - protein, 33 aa, Nasonia vitripennis
SFGGKVGHSACAANCLSMGKAGGRCNGGVCQCR

SEQ ID NO: 392 - protein, 101 aa, Nasonia vitripennis; identical to SEQ ID NO: 388

SEQ ID NO: 393 - protein, 101 aa, Nasonia vitripennis; identical to SEQ ID NO: 390

SEQ ID NO: 394 - protein, 62 aa, Lumbricus rubellus
FSKYERQKDKRPYSERKNQYTGPQFLYPPERIPPQKVIKWNEEGLPIYEIPGEGGHAEPAAA

SEQ ID NO: 395 - protein, 33 aa, Zea mays
RSGRGECRRQCLRRHEGQPWETQECMRRCRRRG

SEQ ID NO: 396 - protein, 82 aa, Mytilus galloprovincialis
MKAVFVLLVVGLCIMMMDVATAGFGCPNNYACHQHCKSIRGYCGGYCASWFRLRCTCYRCGGRRDDVEDIFDIYDNVAVERF

SEQ ID NO: 397 - protein, 78 aa, Equus caballus
GIACWSCRKILQKLEDLVGEQPNEATINEAASRVCRNLGLLRGACKKIMRTCLRLISRDILAGKKPQEVCVDIKLCKH

SEQ ID NO: 398 - protein, 63 aa, Rana grahami
MFTLKKSLLVLFFLGIVSLSVCDQKRDADEEDGGEVTGEEVKRAALKGCWTKSIPPKPCFGKR

SEQ ID NO: 399 - protein, 63 aa, Rana grahami
MFTLKKSLFVLFFLGIVSLSVCEHNRDADEEDGGEAIGGEVRRAALKGCWTKSIPPKPCSGKR

SEQ ID NO: 400 - protein, 63 aa, Rana grahami
MFTLKKSLLVLFFLGIVSLSVCEHNRDADEEDGGEVTGEEVKRAALKGCWTNSIPPKPCSGKR

SEQ ID NO: 401 - protein, 20 aa, Rana grahami
AALRGCWTKSIPPKPCSGKR

SEQ ID NO: 402 - protein, 20 aa, Rana grahami
AVPLIYNRPGIYAPKRPKGK

SEQ ID NO: 403 - protein, 43 aa, Rana grahami
AIGNILKTLGNLAQKILGKQPKMLKLWKWNWKSSDVEYHLAKC

SEQ ID NO: 404 - protein, 19 aa, Rana grahami
AIGNILKTLGNLAQKILGK

SEQ ID NO: 405 - protein, 24 aa, Xenopus laevis
GVLSNVIGYLKKLGTGALNAVLKQ

SEQ ID NO: 406 - protein, 15 aa, Pinus halepensis
FSGSVNQACSGFGWK

SEQ ID NO: 407 - protein, 93 aa, Allium cepa
QNICPRVNRIVTPCVAYGLGRAPIAPCCRALNDLRFVNTRNLRRAACRCLVGVVNRNPGLRRNPRFQNIPRDCRNTFVRPFWWRPRIQCGRIN

SEQ ID NO: 408 - protein, 42 aa, Hippocampus kuda
MKWTAAFLVLVIVVLMAQPGECFLGLIFHGLVHAGKLIHGLI

SEQ ID NO: 409 - protein, 40 aa, Ipomoea nil
QQCGRQASGRLCGNRLCCSQWGYCGSTASYCGAGCQSQCR

SEQ ID NO: 410 - protein, 41 aa, Ipomoea nil
QQCGRQASGRLCGNRLCCSQWGYCGSTASYCGAGCQSQCRS

SEQ ID NO: 411 - protein, 10 aa, Lentinus sajor-caju
DNGEAGRAAR

SEQ ID NO: 412 - protein, 67 aa, Pheretima tschiliensis
MYSKYERQKDKRPYSERKDQYTGPQFLYPPDRIPPSKAIKWNEEGLPMYEVLPDGAGAKTAVEAAAE

SEQ ID NO: 413 - protein, 20 aa, Pleurotus citrinopileatus
VYINKLTPPCGTMYYACEAV

SEQ ID NO: 414 - protein, 21 aa, Arenicola marina
RWCVYAYVRIRGVLVRYRRCW

SEQ ID NO: 415 - protein, 20 aa, Cicer arietinum
GVGYKVVVTTTAAADDDDVV

SEQ ID NO: 416 - protein, 73 aa, Armadillidium vulgare
MKFFALFSFFVLCVALATAGHLGRPYIGGGGGFNRGGGFHRGGGFHRGGGFHSGGGFHRGGGFHSGGSFGYRG

SEQ ID NO: 417 - protein, 7 aa, Allium cepa
  var. aggregatum
YQCGQGG

SEQ ID NO: 418 - protein, 43 aa, Procambarus clarkii
MRLLHLLLSVALVALMAAVPSQASNGYRPAYRPAYRPSYRPGK

SEQ ID NO: 419 - protein, 90 aa, Anopheles albimanus
AFEPHEERALQDERQTKGHRLKRQFSLNFGATHEDGYGTDVNAEALANLWKSASGNTKLEGSASYMQHFGGVGGDGKARISGNLLFSHNY

SEQ ID NO: 420 - protein, 13 aa, Litoria raniformis
GLFDIIKKIAESF

SEQ ID NO: 421 - protein, 14 aa, Litoria aurea
FDIVKKVVGTIAGL

SEQ ID NO: 422 - protein, 16 aa, Litoria raniformis
GLFDIVKKVVGAFGSL

SEQ ID NO: 423 - protein, 16 aa, Litoria aurea
GLFDIVKKVVGAFGSL

SEQ ID NO: 424 - protein, 16 aa, Litoria raniformis
GLFDIAKKVIGVIGSL

SEQ ID NO: 425 - protein, 17 aa, Litoria raniformis
GLFDIVKKIAGHIAGSI

SEQ ID NO: 426 - protein, 17 aa, Litoria aurea
GLFDIVKKIAGHIAGSI

SEQ ID NO: 427 - protein, 17 aa, Litoria raniformis
GLFDIVKKIAGHIASSI

SEQ ID NO: 428 - protein, 17 aa, Litoria aurea
GLFDIVKKIAGHIASSI

SEQ ID NO: 429 - protein, 17 aa, Litoria raniformis
GLFDIVKKIAGHIVSSI

SEQ ID NO: 430 - protein, 60 aa, Ovis aries
RRLRPRRPRLPRPRPRPRPRPRSLPLPRPQPRRIPRPILLPWRPPRPIPRPQPQPIPRWL

SEQ ID NO: 431 - protein, 259 aa, Bordetella bronchiseptica
  RB50
MNNLYRDLAPISAAAWAQIEEEVARTFKRSVAGRRVVDVKDPGGFGLAAVGTGHLRGIAAPQKGVDAKLREVKALVELTVPFELQRDEIDAVERGANDADWQPAKDAATELAYAEDRAIFDGYKAAGIVGIREGSSNSRLELPTDAADYPAAVGRALEQLRLAGVDGPYSVLLGADAYTALSEGSDDGYPTIDHIKRIVSGDIIWAPALNGGCVLSTRGGDFELHLGQDLSIGYQSHTDKVVRLYLRETLTFLMLTSEA

SEQ ID NO: 432 - protein, 259 aa, Bordetella parapertussis; identical to SEQ ID NO: 431
  12822

SEQ ID NO: 433 - protein, 42 aa, Lactobacillus sakei
  MOD_RES (32)..(32): Any amino acid
TKYYGNGVYCNSKKCWVDWGQAAGGIGQTVVXGWLGGAIPGK

SEQ ID NO: 434 - protein, 43 aa, Escherichia coli
VGIGGGGGGGGGGSCGGQGGGCGGCSNGCSGGNGGSGGSGSHI

SEQ ID NO: 435 - protein, 259 aa, Gluconacetobacter diazotrophicus
  PAl 5
MNNLHRELAPISEAAWAQIEEEASRTLKRYLAARRVVDVPEAKGFGFSAVGTGHVERIDAPGSDIRAVRRNVLPLVELRVPFTLARDAIDDVERGAGDSDWQPLKDAAKKIAFAEDRAVFDGYAAAGILGLREGTSNPKLALPSSASDYPAAIAAALNQLRLAGVNGPYAVVLGAGVYTALSGGDDEGYPVFRHIESLIDGKIVWAPAIEGGFVLSTRGGDFELDIGQDFSIGYSSHSADSVELYLQESFTFQLLTTEA

SEQ ID NO: 436 - protein, 36 aa, Macaca mulatta
NPVTCLRSGAICHPGFCPRRYKHIGICGVSAIKCCK

SEQ ID NO: 437 - protein, 36 aa, Macaca mulatta
NPVTCIRSGAICHPGFCPGRYKHIGVCGVPLIKCCK

SEQ ID NO: 438 - protein, 36 aa, Macaca mulatta
NPVTCLRSGAICHPGFCPRRYKHIGVCGVSAIKCCK

SEQ ID NO: 439 - protein, 51 aa, Homo sapiens
GLDFSQPFPSGEFAVCESCKLGRGKCRKECLENEKPDGNCRLNFLCCRQRI

SEQ ID NO: 440 - protein, 36 aa, Capra hircus
NHRSCHRIKGVCAPDRCPRNMRQIGTCFGPPVKCCR

SEQ ID NO: 441 - protein, 36 aa, Gorilla gorilla
DHYNCVSSGGQCLYSACPIFTKIQGTCYGGKAKCCK

SEQ ID NO: 442 - protein, 36 aa, Gorilla gorilla
QKYYCRVRGGRCAVLSCLPKEEQIGKCSTRGRKCCR

SEQ ID NO: 443 - protein, 51 aa, Mus musculus
AVGSLKSIGYEAELDHCHTNGGYCVRAICPPSARRPGSCFPEKNPCCKYMK

SEQ ID NO: 444 - protein, 36 aa, Equus caballus
NPISCARNRGVCIPIGCLPGMKQIGTCGLPGTKCCR

SEQ ID NO: 445 - protein, 36 aa, Pongo pygmaeus
NPVTCLRSGAICHPGFCPRRYKHIGTCGLSVIKCCK

SEQ ID NO: 446 - protein, 36 aa, Equus caballus
NSVTCSKNGGFCISPKCLPGSKQIGTCSLPGSKCCK

SEQ ID NO: 447 - protein, 51 aa, Mus musculus
DDSIQCFQKNNTCHTNQCPYFQDEIGTCYDKRGKCCQKRLLHIRVPRKKKV

SEQ ID NO: 448 - protein, 38 aa, Capra hircus
NHRSCYRNKGVCAPARCPRNMRQIGTCHGPPVKCCRKK

SEQ ID NO: 449 - protein, 36 aa, Anas platyrhynchos
DTLACRQSHGSCSFVACRAPSVDIGTCRGGKLKCCK

SEQ ID NO: 450 - protein, 16 aa, Basella alba
KIMAKPSKFYEQLRGR

SEQ ID NO: 451 - protein, 36 aa, Macaca fascicularis
DHYNCVRSGGQCLYSACPIYTRIQGTCYHGKAKCCK

SEQ ID NO: 452 - protein, 35 aa, Canis lupus
  Canis lupus familiaris
DQYICARKGGTCNFSPCPLFTRIDGTCYRGKAKCC

SEQ ID NO: 453 - protein, 36 aa, Equus asinus
NSVTCSKNGGFCISPKCPPGMKQIGTCGLPGSKCCR

SEQ ID NO: 454 - protein, 35 aa, Rangifer tarandus
PQSCHRNKGVCVPIRCPRSMRQIGTCLGAPVKCCR

SEQ ID NO: 455 - protein, 50 aa, Mus musculus
DLKHLILKAQLTRCYKFGGFCHYNICPGNSRFMSNCHPENLRCCKNIKQF

SEQ ID NO: 456 - protein, 38 aa, Canis lupus
  Canis lupus familiaris
LSGRVLFPLSCIGSSGFCFPFRCPHNREEIGRCFFPIQ

SEQ ID NO: 457 - protein, 36 aa, Pan troglodytes
QKYYCRVRGGRCAVLTCLPKEEQIGKCSTRGRKCCR

SEQ ID NO: 458 - protein, 50 aa, Pan troglodytes
EFELDRICGYGTARCRKKCRSQEYRIGRCPNTYACCLRKWDESLLNRTKP

SEQ ID NO: 459 - protein, 51 aa, Pan troglodytes; identical to SEQ ID NO: 439

SEQ ID NO: 460 - protein, 45 aa, Pan troglodytes
FFDEKCNKLKGTCKNNCGKNEELIALCQKSLKCCRTIQPCGSIID

SEQ ID NO: 461 - protein, 54 aa, Mus musculus
DLKHLILKAQLARCYKFGGFCYNSMCPPHTKFIGNCHPDHLHCCINMKELEGST

SEQ ID NO: 462 - protein, 52 aa, Canis lupus
  Canis lupus familiaris
LALGHMQPGRSEFKRCWKGQGACRTYCTRQETYLHMCPDASLCCLPYGSRPL

SEQ ID NO: 463 - protein, 58 aa, Canis lupus
  Canis lupus familiaris
KVTEQLKRCWGEYIRGYCRKICRISEIREVLCENGRYCCLNIVELEARRKITKPPPPE

SEQ ID NO: 464 - protein, 45 aa, Mus musculus
FLPKTLRKFFCRIRGGRCAVLNCLGKEEQIGRCSNSGRKCCRKKK

SEQ ID NO: 465 - protein, 36 aa, Sus scrofa
DHYICAKKGGTCNFSPCPLFNRIEGTCYSGKAKCCI

SEQ ID NO: 466 - protein, 61 aa, Mus musculus
FFFFDEKCSRINGRCTASCLKNEELVALCWKNLKCCVTVQSCGRSKGNQSDEGSGHMGTRG

SEQ ID NO: 467 - protein, 36 aa, Mus musculus
DTIACIENKDTCRLKNCPRLHNVVGTCYEGKGKCCH

SEQ ID NO: 468 - protein, 36 aa, Pan troglodytes
DPVTCLKSGAICHPVFCPRRYKQIGTCGLPGTKCCK

SEQ ID NO: 469 - protein, 41 aa, Mus musculus
KTINNPVSCCMIGGICRYLCKGNILQNGNCGVTSLNCCKRK

SEQ ID NO: 470 - protein, 35 aa, Equus caballus
SFSCSQNGGFCISPKCLPGSKQIGTCILPGSKCCR

SEQ ID NO: 471 - protein, 50 aa, Gorilla gorilla
EFELDRICGYGTARCRKKCRSQEYRIGRCPNTFACCLRKWDESLLNRTKP

SEQ ID NO: 472 - protein, 50 aa, Pongo pygmaeus; identical to SEQ ID NO: 458

SEQ ID NO: 473 - protein, 50 aa, Hylobates lar
EFEWDRICGYGTARCRNKCRSQEYRIGRCPNTFACCLRKWDESLLNSTKP

SEQ ID NO: 474 - protein, 51 aa, Pongo pygmaeus
GLDFSQPFPSDEFAVCESCKLGRGKCRKECLENEKPDGNCRLNFLCCRERI

SEQ ID NO: 475 - protein, 51 aa, Gorilla gorilla; identical to SEQ ID NO: 439

SEQ ID NO: 476 - protein, 51 aa, Hylobates lar
GLDFSQPFPSGEFAVFESCKFSRGKCRKECLENEKPDGNCRLNFLCCRQSI

SEQ ID NO: 477 - protein, 51 aa, Macaca fascicularis
GLEFSEPFPSGRFAVCESCKLGRGKCRKECLENEKPDGSCRLNFLCCRPRM

SEQ ID NO: 478 - protein, 45 aa, Hylobates lar
FFDDKCDKLRGTCKNSCEKNEELTSFCQKSLKCCRTIQTCGNTTD

SEQ ID NO: 479 - protein, 45 aa, Pongo pygmaeus
FFDEKCGKLKGTCKNNCGKNEELIALCQKSLKCCRTIQPCGSIID

SEQ ID NO: 480 - protein, 45 aa, Gorilla gorilla; identical to SEQ ID NO: 460

SEQ ID NO: 481 - protein, 24 aa, Bombina variegata
GIGALSAKGALKGLAKGLAZHFAN

SEQ ID NO: 482 - protein, 18 aa, Bombina orientalis
IIGPVLGLVGKPLESLLE

SEQ ID NO: 483 - protein, 27 aa, Bombina variegata
GIGASILSAGKSALKGFAKGLAEHFAN

SEQ ID NO: 484 - protein, 27 aa, Bombina orientalis
GIGSAILSAGKSALKGLAKGLAEHFAN

SEQ ID NO: 485 - protein, 206 aa, Homo sapiens [sequence omitted]

SEQ ID NO: 486 - protein, 117 aa, Mus musculus
TCRYLLVRRAECFDKAQSVCRRCYRGTLASIHSFSVNFGIQSAVRGINQGQVWIGGRIKGWGRCKRFRWVDGSSWNFAYWAAGQPCPGGGRCVTLCTQGGHWRLSHCVKRRPFICSY

SEQ ID NO: 487 - protein, 117 aa, Rattus norvegicus
TGRYLLVRRPECFNKAQLVCRSCYRGTLASIHSFSVNFRIQSFVRGINQGQVWIGGRIVGWGRCKRFRWIDGSSWNFAYWAAGQPRRGGGRCVTLCTRGGHWRRSGCGKRRPFICAY

SEQ ID NO: 488 - protein, 24 aa, Rana berlandieri
FLPAIAGMAAKFLPKIFCAISKKC

SEQ ID NO: 489 - protein, 24 aa, Rana berlandieri
FLPAIAGVAAKFLPKIFCAISKKC

SEQ ID NO: 490 - protein, 24 aa, Rana chiricahuensis
FLPVIAGLAAKVLPKLFCAITKKC

SEQ ID NO: 491 - protein, 24 aa, Rana grahami
FLPLLAGLAANFLPKLFCKITKKC

SEQ ID NO: 492 - protein, 24 aa, Rana grahami
FLPLLAGLAANFLPKLFCKITKKC

SEQ ID NO: 493 - protein, 24 aa, Rana grahami
FLPFLAGLAANFLPKLFCKITRKC

SEQ ID NO: 494 - protein, 24 aa, Rana grahami
FLPLLAGLAANFLPKLFCKITRKC

SEQ ID NO: 495 - protein, 71 aa, Amolops ricketti
MFTFKKSMLLLFFLGTINLSLCEQERNADEEERRDDPDETNVEVEKRFLPLLAGVVANFLPQIICKIARKC

SEQ ID NO: 496 - protein, 24 aa, Rana fukienensis
FLPALIGIAAKALPSLLCKITKKC

SEQ ID NO: 497 - protein, 24 aa, Rana ridibunda
FFPAIFRLVAKVVPSIICSVTKKC

SEQ ID NO: 498 - protein, 24 aa, Rana ridibunda
VIPFVASVAAEMMQHVYCAASRRC

SEQ ID NO: 499 - protein, 24 aa, Rana andersonii
FLPAVIRVAANVLPTAFCAISKKC

SEQ ID NO: 500 - protein, 24 aa, Rana andersonii
FLPAVIRVAANVLPTVFCAISKKC

SEQ ID NO: 501 - protein, 24 aa, Rana andersonii
FLPLIAGLAANFLPKLFCKITKKC

SEQ ID NO: 502 - protein, 24 aa, Rana andersonii
FLPLIAGLAANFLPKLFCKITKKC

SEQ ID NO: 503 - protein, 24 aa, Rana andersonii
FLPLIAGLAANFLPKLFCKITKKC

SEQ ID NO: 504 - protein, 71 aa, Amolops ricketti
MFTFKKSMLLLFFLGTINLSLCEQERNADEEERRDDEDKRDVEVEKRFLGSLLGLVGKIVPTLICKISKKC

SEQ ID NO: 505 - protein, 71 aa, Amolops ricketti
MFTSKKSMLLLFFLGTINLSLCEQERNADEEERRDDEDKRDVEVEKRFLGSLLGLVGKVVPTLFCKISKKC

SEQ ID NO: 506 - protein, 24 aa, Rana schmackeri
FFPAILRVAAKVGPAVLCAITKKC

SEQ ID NO: 507 - protein, 24 aa, Rana versabilis
FLPLIASVAANLVPKIFCKITKKC

SEQ ID NO: 508 - protein, 24 aa, Rana versabilis
FLPLIAGLAANFLPKIFCAITKKC

SEQ ID NO: 509 - protein, 33 aa, Rana dybowskii
GLFSVVTGVLKAVGKNVAGSLLEQLKCKISGGC

SEQ ID NO: 510 - protein, 33 aa, Rana grahami
GLLDTFKNMALNAAKSAGVSVLNALSCKLSKTC

SEQ ID NO: 511 - protein, 33 aa, Rana grahami
GLLDTFKNLALNAPKSAGVSVLNSLSCKLSKTC

SEQ ID NO: 512 - protein, 33 aa, Odorrana grahami
GLLDTFKNLALNAAKSAGVSVLNSLSCKLFKTC

SEQ ID NO: 513 - protein, 33 aa, Rana grahami; identical to SEQ ID NO: 41

SEQ ID NO: 514 - protein, 33 aa, Rana grahami
GLLDTFKNMALNAAKSAGVSVLNSLSCKLSKTC

SEQ ID NO: 515 - protein, 33 aa, Rana latouchii
GVLDTFKDVAIGVAKGAGTGVLKALLCKLDKSC

SEQ ID NO: 516 - protein, 29 aa, Rana ridibunda
GILDSLKNFAKDAAGILLKKASCKLSGQC

SEQ ID NO: 517 - protein, 33 aa, Rana andersonii
SFLTSFKDMAIKVAKDAGVNILNTISCKIFKTC

SEQ ID NO: 518 - protein, 33 aa, Rana andersonii
SFLTSFKDMAIKVAKDAGVNILNTISCKISKTC

SEQ ID NO: 519 - protein, 33 aa, Rana andersonii
GLLDTLKNMAINAAKDAGVSVLNTLSCKLSKTC

SEQ ID NO: 520 - protein, 33 aa, Rana andersonii
GFLDTLKNMALNAAKGAGGSVLKALFCKLFKTC

SEQ ID NO: 521 - protein, 33 aa, Rana andersonii
GLLDTLKNMATNAAKGAGVSVLKALSCKLFKTC

SEQ ID NO: 522 - protein, 33 aa, Rana andersonii
GLLDTLKNMAINAAKGAGVSVLNALSCKLSKTC

SEQ ID NO: 523 - protein, 29 aa, Rana ridibunda
GLMSTLKGAATNAAVTLLNKLQCKLTGTC

SEQ ID NO: 524 - protein, 29 aa, Rana ridibunda
GLMSTLKGAATNVAVTLLNKLQCKLTGTC

SEQ ID NO: 525 - protein, 29 aa, Rana ridibunda
GILDSLKNLAKNAAQILLNKASCKLSGQC

SEQ ID NO: 526 - protein, 74 aa, Amolops ricketti
MFTTKKSLLVLFFLGTISLSFCEEERNADEDDGEMTEEEKRGLMSTLKDFGKTAAKEIAQSLLSTASCKLAKTC

SEQ ID NO: 527 - protein, 74 aa, Amolops ricketti
MFTSKKSLLVLFFLGTISLSFCEEERNADEDDGEMTEEVKRGILDTLKEFGKTAAKGIAQSLLSTASCKLAKTC

SEQ ID NO: 528 - protein, 74 aa, Mesobuthus martensii
MEIKYLLTVFLVLLIVSDHCQAFLFSLIPSAISGLISAFKGRRKRDLNGQIDHFKNFRKRDAELEELLSKLPIY

SEQ ID NO: 529 - protein, 25 aa, Litoria splendida
GLLSVLGSVAKHVLPHVVPVIAEHL

SEQ ID NO: 530 - protein, 25 aa, Litoria gilleni
GLLSVLGSVAKHVLPHVVPVIAEHL

SEQ ID NO: 531 - protein, 74 aa, Mesobuthus eupeus
MEIKYLLTVFLVLLIVSDHCQAFLFSLIPSAISGLISAFKGKRRRDLNAQIDQFKNFRKRDAELEELLSKLPIY

SEQ ID NO: 532 - protein, 25 aa, Litoria gilleni
GLVSSIGRALGGLLADVVKSKEQPA

SEQ ID NO: 533 - protein, 15 aa, Homo sapiens
VAIALKAAHYHTHKE

SEQ ID NO: 534 - protein, 114 aa, Homo sapiens
MTCKMSQLERNIETIINTFHQYSVKLGHPDTLNQGEFKELVRKDLQNFLKKENKNEKVIEHIMEDLDTNADKQLSFEEFIMLMARLTWASHEKMHEGDEGPGHHHKPGLGEGTP

SEQ ID NO: 535 - protein, 48 aa, Bos taurus
SDEKASPDRHHRFSLSRYAKLANRLSKWIGNRGNRLANPKLLETFKSV

SEQ ID NO: 536 - protein, 33 aa, Carnobacterium maltaromaticum
  MOD_RES (1)..(1): Any amino acid
XNYGNGVSCSKTKCSVNWGQAFQERYTAGINSF

SEQ ID NO: 537 - protein, 545 aa, Ricinus communis
STTHQEVRPLAYFPPTVWGNRFASLTFNPSEFESYDERVIVLKKKVKDILISSTSDSVETVILIDLLCRLGVSYHFENDIEELLSKIFNSQPDLVDEKECDLYTAAIVFRVFRQHGFKMSSDVFSKFKDSDGKFKESLRGDAKGMLSLFEASHLSVHGEDILEEAFAFTKDYLQSSAVELFPNLKRHITNALEQPFHSGVPRLEARKFIDLYEADIECRNETLLEFAKLDYNRVQLLHQQELCQFSKWWKDLNLASDIPYARDRMAEIFFWAVAMYFEPDYAHTRMIIAKVVLLISLIDDTIDAYATMEETHILAEAVARWDMSCLEKLPDYMKVIYKLLLNTFSEFEKELTAEGKSYSVKYGREAFQELVRGYYLEAVWRDEGKIPSFDDYLYNGSMTTGLPLVSTASFMGVQEITGLNEFQWLETNPKLSYASGAFIRLVNDLTSHVTEQQRGHVASCIDCYMNQHGVSKDEAVKILQKMATDCWKEINEECMRQSQVSVGHLMRIVNLARLTDVSYKYGDGYTDSQQLKQFVKGLFVDPISI

SEQ ID NO: 538 - protein, 38 aa, Canis lupus
  Canis lupus familiaris
RLKELITTGGQKIGEKIRRIGQRIKDFFKNLQPREEKS

SEQ ID NO: 539 - protein, 91 aa, Bubalus bubalis
SLWLLLLGLVLPSASAQALSYREAVLRAVDRINDGSSEANLYRLLELDPPPKDVEDRGARKPASFRVKETVCPRTSQQPLEQCDFKENGLV

SEQ ID NO: 540 - protein, 28 aa, Pan troglodytes
GDFFRKSKEKIGKEFKRIVQRIKDFLRN

SEQ ID NO: 541 - protein, 175 aa, Rattus norvegicus
MQPHRDVPSLWRSLSLLLLLGLGLPLAVSQTLSYREAVLRAVDDFNQQSLDTNLYRLLDLDSEPQGDEDPDTPKYVRFRVKETVCSKASQQLPEQCAFKEQGVVKQCMGTVTLNQAAESFDISCDAPGIQPFRFKKISRLAGLLRKGGEKFGEKLRKIGQKIKDFFQKLAPEIEQ

SEQ ID NO: 542 - protein, 67 aa, Homo sapiens
VLSYKEAVLRAIDGINQRSSDANLYRLLDLDPRPTMDGDPDTPKPVSFTVKETVCPRTTQQSPEDCD

SEQ ID NO: 543 - protein, 37 aa, Bubalus bubalis
NEDLGTRKPVSFTVKETVCPRTTHQPAEQCGFKERGR

SEQ ID NO: 544 - protein, 28 aa, Bos taurus
GGLRSLGRKILRAWKKYGPIIVPIIRIG

SEQ ID NO: 545 - protein, 30 aa, Bungarus fasciatus
KFFRKLKKSVKKRAKEFFKKPRVIGVSIPF

SEQ ID NO: 546 - protein, 15 aa, Bungarus fasciatus
KFFRKLKKSVKKRAK

SEQ ID NO: 547 - protein, 96 aa, Sus scrofa
QLRYREAVLRAVDRLNEQSSEANLYRLLELDQPPKADEDPGTPKPVSFTVKETVCPRPTRQPPELCDFKEKQCVGTVTLNPSIHSLDISCNEIQSV

SEQ ID NO: 548 - protein, 28 aa, Macaca mulatta
GDFFRKSKEKIGKEFKRIVQRIKDFLRN

SEQ ID NO: 549 - protein, 67 aa, Macaca mulatta; identical to SEQ ID NO: 542

SEQ ID NO: 550 - protein, 32 aa, Oiketicus kirbyi
WKPFKKIEKAVRRVRDGVAKAGPAVAVVGQAT

SEQ ID NO: 551 - protein, 60 aa, Anopheles albimanus
MNFTKLFIMVAIAVLLIAGIQPVEAAPRMEIGKRREKLGRNVFKAAKKALPVIAGYKALG

SEQ ID NO: 552 - protein, 62 aa, Pseudoplusia includens
MNFKKILFFVFACLVFTVTAAPEPRWKFFKKIEKVGQNIRDGIIKAGPAVAVVGQAAAISGK

SEQ ID NO: 553 - protein, 65 aa, Bombyx mori
MNFSRALFYVFAVFLVCASVMAAPEPRWKIFKKIEKVGQNIRDGIIKAGPAVAVVGQAATIAHGK

SEQ ID NO: 554 - protein, 34 aa, Aedes aegypti
GGLKKLGKKLEGAGKRVFNAAEKALPVVAGAKAL

SEQ ID NO: 555 - protein, 35 aa, Heliothis virescens
RWKVFKKIEKVGRNIRDGVIKAAPAIEVLGQAKAL

SEQ ID NO: 556 - protein, 35 aa, Anopheles gambiae
GRLKKLGKKIEGAGKRVFKAAEKALPVVAGVKALG

SEQ ID NO: 557 - protein, 33 aa, Heliothis virescens
KWKVFKKIEKVGRNIRDGIVKAGPAIAVLGQAN

SEQ ID NO: 558 - protein, 33 aa, Heliothis virescens
RWKVFKKIEKMGRNIRDGVIKAAPAIEVLGQAK

SEQ ID NO: 559 - protein, 19 aa, Agrius convolvuli
NPFKELERAGQRVRDAIIS

SEQ ID NO: 560 - protein, 36 aa, Hyalophora cecropia
WNPFKELEKVGQRVRDAVISAGPAVATVAQATALAK

SEQ ID NO: 561 - protein, 39 aa, Galleria mellonella
ENFFKEIERAGQRIRDAIISAAPAVETLAQAQKIIKGGD

SEQ ID NO: 562 - protein, 20 aa, Artificial Sequence
  Description of Artificial Sequence: Synthetic anti-microbial peptide
TLRGDERILSILRHQNLLKE

SEQ ID NO: 563 - protein, 30 aa, Artificial Sequence
  Description of Artificial Sequence: Synthetic anti-microbial polypeptide
TLRGDERILSILRHQNLLKELQDLALQGAK

SEQ ID NO: 564 - protein, 14 aa, Artificial Sequence
  Description of Artificial Sequence: Synthetic anti-microbial peptide
RILSILRHQNLLKE

SEQ ID NO: 565 - protein, 24 aa, Artificial Sequence
  Description of Artificial Sequence: Synthetic anti-microbial peptide
RILSILRHQNLLKELQDLALQGAK

SEQ ID NO: 566 - protein, 12 aa, Artificial Sequence
  Description of Artificial Sequence: Synthetic anti-microbial peptide
  MOD_RES (12)..(12): Any amino acid
FQWQRNIRKVRX

SEQ ID NO: 567 - protein, 18 aa, Artificial Sequence
  Description of Artificial Sequence: Synthetic anti-microbial peptide
  MOD_RES (1)..(1): Any amino acid
XNLRRIIRKGIHIIKKYG

SEQ ID NO: 568 - protein, 18 aa, Artificial Sequence
  Description of Artificial Sequence: Synthetic anti-microbial peptide
  MOD_RES (1)..(1): Any amino acid
XNLRRIIRKIIHIIKKYG

SEQ ID NO: 569 - protein, 18 aa, Artificial Sequence
  Description of Artificial Sequence: Synthetic anti-microbial peptide
  MOD_RES (1)..(1): Any amino acid
XNLRRITRKIIHIIKKYG

SEQ ID NO: 570 - protein, 6 aa, Artificial Sequence
  Description of Artificial Sequence: Synthetic anti-microbial peptide
RRWFWR

SEQ ID NO: 571 - protein, 6 aa, Artificial Sequence
  Description of Artificial Sequence: Synthetic anti-microbial peptide
RRWWFR

SEQ ID NO: 572 - protein, 10 aa, Artificial Sequence
  Description of Artificial Sequence: Synthetic anti-microbial peptide
RFPWWWPFLR

SEQ ID NO: 573 - protein, 55 aa, Cicada flammata
NEYHGFVDKANNENKRKKQQGRDDFVVKPNNFANRRRKDDYNENYYDDVDAADVV

SEQ ID NO: 574 - protein, 20 aa, Cicer arietinum
VKSTGRADDDLAVKTKYLPP

SEQ ID NO: 575 - protein, 20 aa, Cicer arietinum
ARCENFADSYRQPPISSSQT

SEQ ID NO: 576 - protein, 30 aa, Chassalia parviflora
GIPCGESCVWIPCISAALGCSCKNKVCYRN

SEQ ID NO: 577 - protein, 37 aa, Unknown
  Description of Unknown: Platyrrhini peptide
RLGDILQKAREKIEGGLKKLVQKIKDFFGKFAPRTES

SEQ ID NO: 578 - protein, 33 aa, Enterococcus hirae
YYGNGLYCNKEKCWVDWNQAKGEIGKIIVNGWV

SEQ ID NO: 579 - protein, 23 aa, Styela clava
LFKLLGKIIHHVGNFVHGFSHVF

SEQ ID NO: 580 - protein, 10 aa, Phaseolus coccineus
KQTENLADTY

SEQ ID NO: 581 - protein, 7 aa, Colletotrichum dematium
VISIIPV

SEQ ID NO: 582 - protein, 34 aa, Oryctolagus cuniculus
GICACRRRFCPNSERFSGYCRVNGARYVRCCSRR

SEQ ID NO: 583 - protein, 33 aa, Oryctolagus cuniculus
VVCACRRALCLPRERRAGFCRIRGRIHPLCCRR

SEQ ID NO: 584 - protein, 33 aa, Oryctolagus cuniculus
VVCACRRALCLPLERRAGFCRIRGRIHPLCCRR

SEQ ID NO: 585 - protein, 34 aa, Oryctolagus cuniculus
GICACRRRFCLNFEQFSGYCRVNGARYVRCCSRR

SEQ ID NO: 586 - protein, 19 aa, Petromyzon marinus
CPCGRRRCCVRGLNVYCCF

SEQ ID NO: 587 - protein, 109 aa, Procambarus clarkii
MVVMAIGAVMAAKPPCLSLNPKVDIPRCTNSCQAEDKPGLFFCCDNKGTNAGKCPRVHLQQDEREVLCDKNQLNYPNHLNCKQDSDCHLWEKCCFLPDNNQLICRSSEV

SEQ ID NO: 588 - protein, 110 aa, Procambarus clarkii
MLRVLVLSMLVVAALGHLPRPKPPQPGCNYYCTKPEGPNKGAKYCCGPQFLPLIREEKHNGFCPPPLKDCTRILPPQVCPHDGHCPINQKCCFDTCLDLHTCKPAHFYIN

SEQ ID NO: 589 - protein, 117 aa, Fenneropenaeus indicus
MLKFVVLSVVAVAVVQSQEDTRFLGVSGGVAGGGFVPGVPGHGGIAPGFECNYCRTRYGYVCCKPGRCPPVRDTCPGIRNRPPICRQDTECFGSDKCCYDTCLNDTVCKPIVLGSEG

SEQ ID NO: 590 - protein, 73 aa, Penaeus monodon
PWRSIECNYCRTRYGYVCCKPGRCPQIRETCPGLRKGVPICRQDTDCFGSDKCCFDTCLNDTVCKPIVAGSQG

SEQ ID NO: 591 - protein, 141 aa, Penaeus monodon
MLKFVVLSVVAVAVVHAQDKGNADTRFLGGVGVPGGGVPGVGVPGVGGGFLPGVPGHGGVVPGGGGLLPGGQFECNYCRTRYGYVCCKPGRCPQIRETCPGLRKGIPICRQDTDCFGSDKCCFDTCLNDTVCKPIVLGSEG

SEQ ID NO: 592 - protein, 38 aa, Mus musculus
LQDAALGWGRRCPRCPPCPRCSWCPRCPTCPGCNCNPK

SEQ ID NO: 593 - protein, 38 aa, Mus musculus
LQDAAVGWGRRCPQCPRCPSCPSCPRCPRCPRCKCNPK

SEQ ID NO: 594 - protein, 38 aa, Mus musculus; identical to SEQ ID NO: 593

SEQ ID NO: 595 - protein, 38 aa, Mus musculus; identical to SEQ ID NO: 593

SEQ ID NO: 596 - protein, 38 aa, Mus musculus
LQDAALGWGRRCPRCPPCPRCSWCPRCPTCPRCNCNPK

SEQ ID NO: 597 - protein, 24 aa, Cryptotympana dubia
GLLNGLALRLGKRALKKIIKRLCR

SEQ ID NO: 598 - protein, 25 aa, Artificial Sequence
  Description of Artificial Sequence: Synthetic anti-microbial peptide
IGKEFKRIVQRIKDFLRNLVPRTES

SEQ ID NO: 599 - protein, 19 aa, Cucurbita maxima
PQRGEGGRAGNLLREEQEI

SEQ ID NO: 600 - protein, 6 aa, Annona cherimola
PGLGFY

SEQ ID NO: 601 - protein, 9 aa, Annona cherimola
PGMGIYLPM

SEQ ID NO: 602 - protein, 30 aa, Viola biflora
GIPCAESCVWIPCTVTALIGCGCSNKVCYN

SEQ ID NO: 603 - protein, 31 aa, Viola biflora
GTFPCGESCVFIPCLTSAIGCSCKSKVCYKN

SEQ ID NO: 604 - protein, 31 aa, Viola biflora
GLLPCAESCVYIPCLTTVIGCSCKSKVCYKN

SEQ ID NO: 605 - protein, 30 aa, Viola biflora
GIPCGESCVWIPCISSAIGCSCKSKVCYRN

SEQ ID NO: 606 - protein, 51 aa, Sinapis alba
QKLCERPSGTWSGVCGNNNACKNQCINLEKARHGSCNYVFPAHKCICYFPC

SEQ ID NO: 607 - protein, 51 aa, Arabidopsis thaliana
QKLCERPSGTWSGVCGNSNACKNQCINLEKARHGSCNYVFPAHKCICYFPC

SEQ ID NO: 608 - protein, 27 aa, Brassica rapa
  subsp. Rapa
QKLCERPSGTWSGVCGNNNACKNQCIN

SEQ ID NO: 609 - protein, 51 aa, Brassica napus; identical to SEQ ID NO: 606

SEQ ID NO: 610 - protein, 51 aa, Raphanus sativus; identical to SEQ ID NO: 606

SEQ ID NO: 611 - protein, 51 aa, Raphanus sativus
QKLCQRPSGTWSGVCGNNNACKNQCIRLEKARHGSCNYVFPAHKCICYFPC

SEQ ID NO: 612 - protein, 23 aa, Brassica napus
QKLCERPSGTWSGVCGNNNACKN

SEQ ID NO: 613 - protein, 27 aa, Brassica rapa
  MOD_RES (11)..(11): Any amino acid
QKLCERPSGTXSGVCGNNNACKNQCIR

SEQ ID NO: 614 - protein, 51 aa, Sinapis alba
QKLCQRPSGTWSGVCGNNNACRNQCINLEKARHGSCNYVFPAHKCICYFPC

SEQ ID NO: 615 - protein, 52 aa, Sinapis alba
QKLCARPSGTWSSGNCRNNNACRNFCIKLEKSRHGSCNIPFPSNKCICYFPC

SEQ ID NO: 616 - protein, 50 aa, Brassica napus
KLCERSSGTWSGVCGNNNACKNQCIRLEGAQHGSCNYVFPAHKCICYFPC

SEQ ID NO: 617 - protein, 50 aa, Raphanus sativus; identical to SEQ ID NO: 616

SEQ ID NO: 618 - protein, 48 aa, Raphanus sativus
QKLCERSSGTWSGVCGNNNACKNQCINLEGARHGSCNYIFPYHRCICY

SEQ ID NO: 619 - protein, 69 aa, Lachesana tarabaevi
GFFGNTWKKIKGKADKIMLKKAVKIMVKKEGISKEEAQAKVDAMSKKQIRLYVLKHYGKKALQKVSEKL

SEQ ID NO: 620 - protein, 69 aa, Lachesana tarabaevi
GFFGNAWKKIKGKAEKFFRKKAAKIIAKKEGITKEEAEAKVDPMSKKQIKVYLLKHYGKKALQKASEKL

SEQ ID NO: 621 - protein, 71 aa, Lachesana tarabaevi
GFFGNTWKKIKGKADKIMLKKAVKIMVKKEGISKEEAQAKVDAMSKKQIRLYLLKHYGKKLFKKRPKNCDQ

SEQ ID NO: 622 - protein, 71 aa, Lachesana tarabaevi
GFFGNTWKKIKGKADKIMLKKAVKIMVKKEGISKEEAQAKVDAMSKKQIRLYLLKYYGKKLFKKRPKNCDQ

SEQ ID NO: 623 - protein, 75 aa, Lachesana tarabaevi
GFFGNTWKKIKGKADKIMLKKAVKLMVKKEGISKEEAQAKVDAMSKKQIRLYLLKYYGKKSSSKSVRKIVISKSF

SEQ ID NO: 624 - protein, 75 aa, Lachesana tarabaevi
GFFGNTWKKIKGKADKIMLKKAVKIMVKKEGISKEEAQAKVDAMSKKQIRLYVLKHYGKKSSSKSFRKIVISKSF

SEQ ID NO: 625 - protein, 69 aa, Lachesana tarabaevi
GFFGNTWKKIKGKADKIMLKKAVKLMVKKEGISKEEAQAKVDAMSKKQIRLYLLKYYGKKALQKASEKL

SEQ ID NO: 626 - protein, 69 aa, Lachesana tarabaevi
GFFGNTWKKIKGKADKIMLKKAVKIMVKKEGISKEEAQAKVDAMSKKQIRLYVLKYYGKKALQKASEKL

SEQ ID NO: 627 - protein, 69 aa, Lachesana tarabaevi
GFFGNTWKKIKGKADKIMLKKAVKIMVKKEGITKEEAQAKVDAMSKKQIRLYLLKYYGKKALQKASEKL

SEQ ID NO: 628 - protein, 69 aa, Lachesana tarabaevi
GFFGNTWKKIKGKSDKIMLKKAVKIMVKKEGISKEEAQAKVDAMSKKQIRLYLLKYYGKKALQKASEKL

SEQ ID NO: 629 - protein, 11 aa, Oreumenes decoratus
SLLSLIRKLIT

SEQ ID NO: 630 - protein, 36 aa, Cercopithecus preussi
DHYNCVRSGGQCLYSACPIYTKIQGTCYHGKAKCCK

SEQ ID NO: 631 - protein, 36 aa, Chlorocebus aethiops; identical to SEQ ID NO: 630

SEQ ID NO: 632 - protein, 31 aa, Aedes albopictus
GFGVGDSACAAHCIARRNRGGYCNAKTVCVC

SEQ ID NO: 633 - protein, 37 aa, Ornithodoros moubata
GYGCPFNQYQCHSHCSGIRGYKGGYCKGTFKQTCKCY

SEQ ID NO: 634 - protein, 26 aa, Bombus ignitus
HSACAANCLSMGKAGGRCENGVCLCR

SEQ ID NO: 635 - protein, 72 aa, Medicago truncatula
MEKKSLAGLCFLFLVLFVAQEIVVTEAKTCENLADKYRGPCFSGCDTHCTTKENAVSGRCRDDFRCWCTKRC

SEQ ID NO: 636 - protein, 76 aa, Ixodes ricinus
MKVLAVSLAFLLIAGLISTSLAQNEEGGEKELVRVRRGGYYCPFFQDKCHRHCRSFGRKAGYCGGFLKKTCICVMK

SEQ ID NO: 637 - protein, 33 aa, Triatoma infestans
SKWFTPNHAACAAHCILLGNRGGHCVGTVCHCR

SEQ ID NO: 638 - protein, 36 aa, Bos taurus
NPLSCRLNRGICVPIRCPGNLRQIGTCFTPSVKCCR

SEQ ID NO: 639 - protein, 75 aa, Dreissena polymorpha
MMSKLVVFSLLIAAAVMSVSAAPQKRITCDLLGGVWILGADTACAGHCYTLNHPGGHCEGGYCYCRPGTFSEILG

SEQ ID NO: 640 - protein, 111 aa, Zea mays
MPSYKKLVIVGFALTLLLVSFGMDASAKLCSTTMDLLICGGAIPGAVNQACDDTCRNKGYTGGGFCNMKIQRCVCRKPCALEEQTEARAGDEAAGGAGDMMSRTPGRWQIE

SEQ ID NO: 641 - protein, 43 aa, Acalolepta luxuriosa
FTCDVLSVEAKGVKLNHAACGIHCLFRRRTGGYCNKKRVCICR

SEQ ID NO: 642 - protein, 74 aa, Ixodes ricinus
MKVLAVSLAFLLIAGLISTSLAENDEGGEKELVRVRRGGYYCPFRQDKCHRHCRSFGRKAGYCGGFLKKTCICV

SEQ ID NO: 643 - protein, 31 aa, Aedes albopictus
GFGVGDSACAAHCIARGNRGGYCNSKKVCVC

SEQ ID NO: 644 - protein, 47 aa, Capsicum annuum
RTCESQSHRFKGLCFSKSNCGSVCHTEGFNGGHCRGFRRRCFCTRHC

SEQ ID NO: 645 - protein, 84 aa, Amblyomma hebraeum
MATVRNSRPEAAGEPSGVSSTEGDWRHIEKRDVSYQGEGNTRRFDNPFGCPADEGKCFDHCNNKAYDIGYCGGSYRATCVCYRK

SEQ ID NO: 646 - protein, 84 aa, Amblyomma hebraeum
MATQRREISWTFGPLYTWRTTKGYGTTLETTNATSTSSKPSRRYENPYGCPTDEGKCFDRCNDSEFEGGYCGGSYRATCVCYRT

SEQ ID NO: 647 - protein, 23 aa, Mus musculus
CYREGGECLQRCIGLFHKIKCCK

SEQ ID NO: 648 - protein, 49 aa, Triticum kiharae
RTCQSQSHKFKGACFSDTNCDSVCRTENFPRGQCNQHHVERKCYCERDC

SEQ ID NO: 649 - protein, 47 aa, Triticum kiharae
RDCESDSHKFHGACFSDTNCANVCQTEGFTAGKCVGVQRHCHCTKDC

SEQ ID NO: 650 - protein, 49 aa, Triticum kiharae
RTCESQSHKFKGPCFSDSNCATVCRTENFPRGQCNQHHVERKCYCERSC

SEQ ID NO: 651 - protein, 45 aa, Triticum kiharae
RDCKSDSHKFHGACFSDTNCANVCQTEGFTRGKCDGIHCHCIKDC

SEQ ID NO: 652 - protein, 45 aa, Triticum kiharae
RDCTSQSHKFVGLCLSDRNCASVCLTEYFTGGKCDHRRCVCTKGC

SEQ ID NO: 653 - protein, 46 aa, Triticum kiharae
RECRSESKKFVGLCVSDTNCASVCLTERFPGGKCDGYRRCFCTKDC

SEQ ID NO: 654 - protein, 46 aa, Triticum kiharae
RDCRSQSKTFVGLCVSDTNCASVCLTEHFPGGKCDGYRRCFCTKDC

SEQ ID NO: 655 - protein, 46 aa, Triticum kiharae
RECRSQSKQFVGLCVSDTNCASVCLTEHFPGGKCDGYRRCFCTKDC

SEQ ID NO: 656 - protein, 49 aa, Triticum monococcum
RTCQSQSHKFKGACFSDTNCASVCRTENFPRGQCNQHHVERKCYCERDC

SEQ ID NO: 657 - protein, 30 aa, Homo sapiens; identical to SEQ ID NO: 225

SEQ ID NO: 658 - protein, 36 aa, Artificial Sequence; identical to SEQ ID NO: 442
  Description of Artificial Sequence: Synthetic anti-microbial polypeptide

SEQ ID NO: 659 - protein, 45 aa, Homo sapiens; identical to SEQ ID NO: 460

SEQ ID NO: 660 - protein, 44 aa, Homo sapiens
AIHRALISKRMEGHCEAECLTFEVKIGGCRAELAPFCCKNRKKH

SEQ ID NO: 661 - protein, 44 aa, Homo sapiens; identical to SEQ ID NO: 660

SEQ ID NO: 662 - protein, 35 aa, Rattus norvegicus
LRDLKCFCRRKSCNWGEGIMGICKKRYGSPILCCR

SEQ ID NO: 663 - protein, 75 aa, Pan troglodytes
ESLQERADEATTQKQSGEDNQDLAISFAGNGLSALRTSGSQARATCYCRIGHCTILESLSGVCEISGRLYRLCCR

SEQ ID NO: 664 - protein, 75 aa, Pan troglodytes
EPLQARADEMPAQKQPPADDQDVVIYFSGDDSSSLQVPGSTKGLICHCRVLYCLFGEHLGGTSFIHGERYPICCY

SEQ ID NO: 665 - protein, 32 aa, Ornithorhynchus anatinus
DTTFCRCRVSCNILEKYSGKCELSGRTARICC

SEQ ID NO: 666 - protein, 32 aa, Ornithorhynchus anatinus
STITCYCRSRCRMLEKNSGTCRSSNCTYTLCC

SEQ ID NO: 667 - protein, 34 aa, Ornithorhynchus anatinus
RIITCSCRTFCFLGERISGRCYQSVFIYRLCCRG

SEQ ID NO: 668 - protein, 29 aa, Ornithorhynchus anatinus
HSCVCRRICAARQVRKGRCSRRRRICCLY

SEQ ID NO: 669 - protein, 35 aa, Ornithorhynchus anatinus
GMKEKCVTMGGYCRKQCRVQDALSGYCRNENPCCV

SEQ ID NO: 670 - protein, 42 aa, Ornithorhynchus anatinus
GLNNKCAYFRGQCRRKCPQRDIFFGFCRNHDQCCLSSLHTRH

SEQ ID NO: 671 - protein, 38 aa, Ornithorhynchus anatinus
GISRVRICREKGGHCDADCHLEERHLGGCRAAYLTFCC

SEQ ID NO: 672 - protein, 72 aa, Ornithorhynchus anatinus
CKGKLGYCRSKCQSKQVELGKCSTKAICCGISTGTSSSQGSHEVPVINSEPALESKPEPQDTQEEEATMVSE

SEQ ID NO: 673 - protein, 32 aa, Ornithorhynchus anatinus
KKCRERGGQCHSGVCSWNEKFIGFCSFARPCC

SEQ ID NO: 674 - protein, 57 aa, Ornithorhynchus anatinus
KMEILLGSNGGARCDINKKSFDCYHRNGRCRFNCRKREYNNGDCSQYQSCCLPTRNL

SEQ ID NO: 675 - protein, 46 aa, Ornithorhynchus anatinus
EVRRRRRRPPCEDVNGQCQPRGNPCLRLRGACPRGSRCCMPTVAAH

SEQ ID NO: 676 - protein, 64 aa, Arabidopsis thaliana
MRPRSRAGDKFMSQGQELCHEYFQLTAPCEKQPCIDMCSSKYKTGKGVCGPAVHQCFCTFSCTV

SEQ ID NO: 677 - protein, 71 aa, Arabidopsis thaliana
MLLETDASRNKPSSYIPLCGSDNSCGGLWCPRKGGKYSCISMTCDIQEDCPKLVRCKDSPGPYCMEGFCTC

SEQ ID NO: 678 - protein, 35 aa, Mus musculus
LRDLVCYCRSRGCKGRERMNGTCRKGHLLYMLCCR

SEQ ID NO: 679 - protein, 35 aa, Mus musculus
LRDLVCYCRKRGCKRREHMNGTCRRGHLMYTLCCR

SEQ ID NO: 680 - protein, 35 aa, Mus musculus
LRDLVCYCRTRGCKRRERMNGTCRKGHLMHTLCCR

SEQ ID NO: 681 - protein, 35 aa, Mus musculus
LRDLVCYCRKRGCKRREHINGTCRKGHLLYMLCCR

SEQ ID NO: 682 - protein, 35 aa, Mus musculus
LRDLVCYCRKRGCKRREHMNGTCRKGHLLYTLCCR

SEQ ID NO: 683 - protein, 34 aa, Mus musculus
SRDLICYCRKGGCNRGEQVYGTCSGRLLYCCPRR

SEQ ID NO: 684 - protein, 35 aa, Mus musculus
SRDLICLCRNRRCNRGELFYGTCAGPFLRCCRRRR

SEQ ID NO: 685 - protein, 35 aa, Mus musculus
SRDLICLCRKRRCNRGELFYGTCAGPFLRCCRRRR

SEQ ID NO: 686 - protein, 34 aa, Mus musculus
LRDLVCYCRTRGCKRRERMNGTCRKGHLIYTLCC

SEQ ID NO: 687 - protein, 34 aa, Mus musculus
LRDLVCYCRARGCKGRERMNGTCSKGHLLYMLCC

SEQ ID NO: 688 - protein, 35 aa, Mus musculus
CEDLICYCRTRGCKRRERLNGTCRKGHLMYMLWCC

SEQ ID NO: 689 - protein, 35 aa, Mus musculus
LRDLGCYCRKRGCTRRERINGTCRKGHLMYTLCCL

SEQ ID NO: 690 - protein, 35 aa, Mus musculus
SKKLICYCRIRGCKRRERVFGTCRNLFLTFVFCCS

SEQ ID NO: 691 - protein, 35 aa, Mus musculus
LRDLVCYCRTRGCKRREHMNGTCRKGHLMYTLCCR

SEQ ID NO: 692 - protein, 35 aa, Mus musculus
LRDLVCYCRKRGCKRREHMNGTCRKGHLMYTLCCR

SEQ ID NO: 693 - protein, 35 aa, Mus musculus
LRDLVCYCRKRGCKRREHMNGTCRKGHLLYMLCCR

SEQ ID NO: 694 - protein, 56 aa, Mus musculus
RFPWCRKCRVCQKCQVCQKCPVCPTCPQCPKQPLCEERQNKTAITTQAPNTQHKGC

SEQ ID NO: 695 - protein, 26 aa, Mus musculus
PPCPSCLSCPWCPRCLRCPMCKCNPK

SEQ ID NO: 696 - protein, 33 aa, Mus musculus
LGWGRRCPQCPRCPSCPSCPRCPRCPRCKCNPK

SEQ ID NO: 697 - protein, 26 aa, Mus musculus
PRCPPCPRCSWCPRCPTCPRCNCNPK

SEQ ID NO: 698 - protein, 35 aa, Mus musculus
LRDLVCYCRKRGCKGRERMNGTCRKGHLLYTMCCR

SEQ ID NO: 699 - protein, 9 aa, Macaca mulatta
RCICVLGIC

SEQ ID NO: 700 - protein, 28 aa, Phyllomedusa distincta
ALWKTLLKNVGKAAGKAALNAVTDMVNQ

SEQ ID NO: 701 - protein, 27 aa, Phyllomedusa bicolor
DVLKKIGTVALHAGKAALGAVADTISQ

SEQ ID NO: 702 - protein, 31 aa, Phyllomedusa bicolor
AMWKDVLKKIGTVALHAGKAALGAVADTISQ

SEQ ID NO: 703 - protein, 33 aa, Phyllomedusa bicolor
GLWSNIKTAGKEAAKAALKAAGKAALGAVTDAV

SEQ ID NO: 704 - protein, 30 aa, Phyllomedusa bicolor
RGLWSKIKEAGKAALTAAGKAALGAVSDAV

SEQ ID NO: 705 - protein, 48 aa, Phyllomedusa sauvagii
EEEKREGENEKEQEDDNQSEEKRGLVSDLLSTVTGLLGNLGGGGLKKI

SEQ ID NO: 706 - protein, 53 aa, Phyllomedusa sauvagii
EEEKRENEDEEEQEDDEQSEEKRALWKTLLKGAGKVFGHVAKQFLGSQGQPES

SEQ ID NO: 707 - protein, 51 aa, Phyllomedusa sauvagii
EEEKRENEDEENQEDDEQSEMRRGLWSKIKEAAKTAGKMAMGFVNDMVGEQ

SEQ ID NO: 708 - protein, 51 aa, Phyllomedusa sauvagii
DEEKRENEDEENQEDDEQSEMRRGLRSKIKEAAKTAGKMALGFVNDMAGEQ

SEQ ID NO: 709 - protein, 47 aa, Phyllomedusa sauvagii
DEEKRENEDEENQEDDEQSEMRRGLRSKIWLWVLLMIWQESNKFKKM

SEQ ID NO: 710 - protein, 28 aa, Phyllomedusa hypochondrialis
GLWKSLLKNVGVAAGKAALNAVTDMVNQ

SEQ ID NO: 711 - protein, 34 aa, Phyllomedusa hypochondrialis
ALWKDVLKKIGTVALHAGKAAFGAAADTISQGGS

SEQ ID NO: 712 - protein, 33 aa, Phyllomedusa hypochondrialis
GLWSTIKQKGKEAAIAAAKAAGKAVLNAASEAL

SEQ ID NO: 713 - protein, 29 aa, Phyllomedusa hypochondrialis
GLWSTIKQKGKEAAIAAAKAAGQAALGAL

SEQ ID NO: 714 - protein, 33 aa, Phyllomedusa hypochondrialis
GLWSTIKQKGKEAAIAAAKAAGQAVLNSASEAL

SEQ ID NO: 715 - protein, 33 aa, Phyllomedusa hypochondrialis
GLWSTIKQKGKEAAIAAAKAAGQAALNAASEAL

SEQ ID NO: 716 - protein, 26 aa, Agalychnis callidryas
GLLSGILNTAGGLLGNLIGSLSNGES

SEQ ID NO: 717 - protein, 26 aa, Agalychnis callidryas
GLLSGILNSAGGLLGNLIGSLSNGES

SEQ ID NO: 718 - protein, 30 aa, Agalychnis callidryas
SVLSTITDMAKAAGRAALNAITGLVNQGEQ

SEQ ID NO: 719 - protein, 41 aa, Gastrophysa atrocyanea
AVRIGPCDQVCPRIVPERHECCRAHGRSGYAYCSGGGMYCN

SEQ ID NO: 720 - protein, 22 aa, Dicentrarchus labrax
FFHHIFRGIVHVGKSIHKLVTG

SEQ ID NO: 721 - protein, 46 aa, Pisum sativum
NTCEHLADTYRGVCFTNASCDDHCKNKAHLISGTCHDWKCFCTQNC

SEQ ID NO: 722 - protein, 36 aa, Phyllomedusa azurea
NLVSALIEGRKYLKNVLKKLNRLKEKNKAKNSKENN

SEQ ID NO: 723 - protein, 33 aa, Dolabella auricularia
SHQDCYEALHKCMASHSKPFSCSMKFHMCLQQQ

SEQ ID NO: 724 - protein, 71 aa, Drosophila triauraria
MIQIKFLCLFLAIMTIVVLDSNVAEARDCLSGTFKGPCWAWSGEKCRRLCIEEGRVSGHCSGGSKCWCEGC

SEQ ID NO: 725 - protein, 19 aa, Rana dybowskii
RSAVGRHGRRFGLRKHRKH

SEQ ID NO: 726 - protein, 19 aa, Rana dybowskii
RSAVGRHSRRFGLRKHRKH

SEQ ID NO: 727 - protein, 15 aa, Rana dybowskii
VWPLGLVICKALKIC

SEQ ID NO: 728 - protein, 20 aa, Rana dybowskii
FLPLLLAGLPLKLCFLFKKC

SEQ ID NO: 729 - protein, 36 aa, Bubalus bubalis
NPQSCHRNKGICVPIRCPGNMRQIGTCLGPPVKCCR

SEQ ID NO: 730 - protein, 29 aa, Macaca mulatta
MKVFFLFAVLFCLVRRNSVHISHQEARGP

SEQ ID NO: 731 - protein, 25 aa, Epinephelus coioides
FIFHIIKGLFHAGKMIHGLVTRRRH

SEQ ID NO: 732 - protein, 25 aa, Pleurotus eryngii
ATRVVYCNRRSGSVVGGDDTVYYEG

SEQ ID NO: 733 - protein, 46 aa, Rana saharica
GIFSKFGRKKIKNLLISGLKNVGKEVGMDVVRTGIDIAGCKIKGEC

SEQ ID NO: 734 - protein, 46 aa, Rana esculenta
GIFSKLGRKKIKNLLISGLKNVGKEVGMDVVRTGIDIAGCKIKGEC

SEQ ID NO: 735 - protein, 46 aa, Rana saharica
GIFSKLAGKKLKNLLISGLKNVGKEVGMDVVRTGIDIAGCKIKGEC

SEQ ID NO: 736 - protein, 46 aa, Odorrana versabilis
GIFTKINKKKAKTGVFNIIKTIGKEAGMDVIRAGIDTISCKIKGEC

SEQ ID NO: 737 - protein, 37 aa, Rana berlandieri
GLFSILRGAAKFASKGLGKDLTKLGVDLVACKISKQC

SEQ ID NO: 738 - protein, 37 aa, Rana luteiventris
GILSLFTGGIKALGKTLFKMAGKAGAEHLACKATNQC

SEQ ID NO: 739 - protein, 37 aa, Rana grahami
FTLKKSLLVLFFLGTISLSLCQEERAADEEDNGEVEE

SEQ ID NO: 740 - protein, 32 aa, Rana grahami
IKDAAKLIGKTVAKEAGKTGLELMACKITNQC

SEQ ID NO: 741 - protein, 37 aa, Rana grahami
GLFTLIKGAAKLIGRTVAKEAGKTGLELMACKITNQC

SEQ ID NO: 742 - protein, 36 aa, Rana ridibunda
GILSLVKVAKLAGKTFAKEGGKFGLEFIACKVTNQC

SEQ ID NO: 743 - protein, 37 aa, Rana ridibunda
GILSLVKGAAKLLGKGLAKEGGKVGLEFIACKVTNQC

SEQ ID NO: 744 - protein, 37 aa, Rana ridibunda
GIFSLVKGVAKLAGKTLAKEGGKFGLELAMCKIAKQC

SEQ ID NO: 745 - protein, 37 aa, Odorrana versabilis
GLFSILKGVGKIAIKGLGKNLGKMGLDLVSCKISKEC

SEQ ID NO: 746 - protein, 46 aa, Rana grahami
GLFSKFAGKGIKNLIFKGVKHIGKEVGMDVIRTGIDVAGCKIKGEC

SEQ ID NO: 747 - protein, 44 aa, Artificial Sequence
  Description of Artificial Sequence: Synthetic anti-microbial polypeptide
DKLIGSCVWGAVNYTSNCNAECKRRGYKGGHCGSFANVNCWCER

SEQ ID NO: 748 - protein, 44 aa, Artificial Sequence
  Description of Artificial Sequence: Synthetic anti-microbial polypeptide
DKLIGSCVWGAVNYTSNCNAECKRRGYKGGHCGSFANVNCWCQT

SEQ ID NO: 749 - protein, 44 aa, Artificial Sequence
  Description of Artificial Sequence: Synthetic anti-microbial polypeptide
DKLIGSCVWGAVNYTSNCNAECKRRGYKGGHCGSFINVNCWCET

SEQ ID NO: 750 - protein, 44 aa, Artificial Sequence
  Description of Artificial Sequence: Synthetic anti-microbial polypeptide
DKLIGSCVWGAVNYTSNCNAECKRRGYKGGHCGSFANINCWCET

SEQ ID NO: 751 - protein, 44 aa, Artificial Sequence
  Description of Artificial Sequence: Synthetic anti-microbial polypeptide
DKLIGSCVWGAVNYTSNCNAECKRRGYKGGHCGSFLNINCWCET

SEQ ID NO: 752 - protein, 44 aa, Artificial Sequence
  Description of Artificial Sequence: Synthetic anti-microbial polypeptide
DKLIGSCVWGAVNYTSNCNAECKRRGYKGGHCGSFLNVNCWCET

SEQ ID NO: 753 - protein, 44 aa, Artificial Sequence
  Description of Artificial Sequence: Synthetic anti-microbial polypeptide
NKLIGSCVWGAVNYTSNCNAECKRRGYKGGHCGSFANVNCWCET

SEQ ID NO: 754 - protein, 44 aa, Artificial Sequence
  Description of Artificial Sequence: Synthetic anti-microbial polypeptide
DKLIGSCVWGAVNYTRNCNAECKRRGYKGGHCGSFANVNCWCET

SEQ ID NO: 755 - protein, 44 aa, Artificial Sequence
  Description of Artificial Sequence: Synthetic anti-microbial polypeptide
DKLIGSCVWGAVNYTSNCRAECKRRGYKGGHCGSFANVNCWCET

SEQ ID NO: 756 - protein, 44 aa, Artificial Sequence
  Description of Artificial Sequence: Synthetic anti-microbial polypeptide
DKLIGSCVWGAVNYTSRCNAECKRRGYKGGHCGSFANVNCWCET

SEQ ID NO: 757 - protein, 44 aa, Artificial Sequence
  Description of Artificial Sequence: Synthetic anti-microbial polypeptide
DKLIGSCVWLAVNYTSNCNAECKRRGYKGGHCGSFLNVNCWCET

SEQ ID NO: 758 - protein, 44 aa, Artificial Sequence
  Description of Artificial Sequence: Synthetic anti-microbial polypeptide
DKLIGSCVWLAVNYTSNCNAECKRRGYKGGHCGSFANVNCWCET

SEQ ID NO: 759 - protein, 44 aa, Artificial Sequence
  Description of Artificial Sequence: Synthetic anti-microbial polypeptide
DKLIGSCVWGAVNYTSNCRAECKRRGYKGGHCGSFLNVNCWCET

SEQ ID NO: 760 - protein, 58 aa, Helianthus annuus
NEMGGPLVVEARTCESQSHKFKGTCLSDTNCANVCHSERFSGGKCRGFRRRCFCTTHC

SEQ ID NO: 761 - protein, 80 aa, Nicotiana tabacum
RECKTESNTFPGICITKPPCRKACISEKFTDGHCSKLLRRCLCTKPCVFDEKMIKTGAETLVEEAKTLAAALLEEEIMDN

SEQ ID NO: 762 - protein, 12 aa, Litoria infrafrenata
GLLDALSGILGL

SEQ ID NO: 763 - protein, 15 aa, Litoria infrafrenata
GLLGTLGNLLNGLGL

SEQ ID NO: 764 - protein, 22 aa, Litoria infrafrenata
GLMSVLGHAVGNVLGGLFKPKS

SEQ ID NO: 765 - protein, 24 aa, Litoria infrafrenata
GFLDKLKKGASDFANALVNSIKGT

SEQ ID NO: 766 - protein, 33 aa, Rana rugosa
SLFSLIKAGAKFLGKNLLKQGACYAACKASKQC

SEQ ID NO: 767 - protein, 33 aa, Rana rugosa
GIMSIVKDVAKNAAKEAAKGALSTLSCKLAKTC

SEQ ID NO: 768 - protein, 33 aa, Rana rugosa
GIMSIVKDVAKTAAKEAAKGALSTLSCKLAKTC

SEQ ID NO: 769 - protein, 37 aa, Rana rugosa
GILDTLKQFAKGVGKDLVKGAAQGVLSTVSCKLAKTC

SEQ ID NO: 770 - protein, 24 aa, Rana rugosa
FLGALFKVASKVLPSVFCAITKKC

SEQ ID NO: 771 - protein, 24 aa, Rana rugosa
FLPLLAGLAANFLPTIICKISYKC

SEQ ID NO: 772 - protein, 45 aa, Rana nigrovittata
FPMKKSLLLIFFLGTINLSFCEEERNAEEEKRDGDDEMDVEVQKR

SEQ ID NO: 773 - protein, 45 aa, Rana nigrovittata
FTMKKSLLLIFFLGTINLSLCEEERNAEEEKRDGDDEMDVEVQKR

SEQ ID NO: 774 - protein, 44 aa, Rana nigrovittata
FTMKKSLLLLFFLGTINLSLCEKERNAEEEKRDGDDETDVEVQK

SEQ ID NO: 775 - protein, 32 aa, Gallus gallus
TQCRIRGGFCRVGSCRFPHIAIGKCATFISCC

SEQ ID NO: 776 - protein, 36 aa, Gallus gallus; identical to SEQ ID NO: 449

SEQ ID NO: 777 - protein, 249 aa, Homo sapiens
ADNFSLHDALSGSGNPNPQGWPGAWGNQPAGAGGYPGASYPGAYPGQAPPGAYPGQAPPGAYPGAPGAYPGAPAPGVYPGPPSGPGAYPSSGQPSATGAYPATGPYGAPAGPLIVPYNLPLPGGVVPRMLITILGTVKPNANRIALDFQRGNDVAFHFNPRFNENNRRVIVCNTKLDNNWGREERQSVFPFESGKPFKIQVLVEPDHFKVAVNDAHLLQYNHRVKKLNEISKLGISGDIDLTSASYTMI

SEQ ID NO: 778 - protein, 39 aa, Gallus gallus
GRKSDCFRKSGFCAFLKCPSLTLISGKCSRFYLCCKRIW

SEQ ID NO: 779 - protein, 39 aa, Gallus gallus
GRKSDCFRKNGFCAFLKCPYLTLISGKCSRFHLCCKRIW

SEQ ID NO: 780 - protein, 83 aa, Anopheles albimanus
MKVASVCILLAVLLCSAAVADATVYAYASTCARCKSIGAKYCGYGTLRTKGVSCDGQTMIRSCADCKARFGRCVDSYITECFL

SEQ ID NO: 781 - protein, 47 aa, Petunia integrifolia
RTCESQSHRFHGTCVRESNCASVCQTEGFIGGNCRAFRRRCFCTRNC

SEQ ID NO: 782 - protein, 27 aa, Ganoderma lucidum
AGETHTVMINHAGRGAPKLVVGGKKLS

SEQ ID NO: 783 - protein, 40 aa, Ginkgo biloba
ANTAFVSSAHNTQKIPAGAPFNRNLRAMLADLRQNAAFAG

SEQ ID NO: 784 - protein, 107 aa, Streptomyces sp.
  TP-A0584
REYRFHNQLATTEKPEILPRIVSDGIVWARRRWRIRPTDVPRPETGERDVEYLLRLEGWRTQLGLPAEIYVAQVTPTAMGLRRKKPQWVHFEHPYSLWAAFTHLDPH

SEQ ID NO: 785 - protein, 18 aa, Acanthoscurria gomesiana
ZCRRLCYKQRCVTYCRGR

SEQ ID NO: 786 - protein, 123 aa, Homo sapiens
RLSPEYYDLARAHLRDEEKSCPCLAQEGPQGDLLTKTQELGRDYRTCLTIVQKLKKMVDKPTQRSVSNAATRVCRTGRSRWRDVCRNFMRRYQSRVTQGLVAGETAQQICEDLRLCIPSTGPL

SEQ ID NO: 787 - protein, 10 aa, Gymnocladus chinensis
KTCENLADDY

SEQ ID NO: 788 - protein, 26 aa, Hippoglossus sp.
GFLGILFHGVHHGRKKALHMNSERRS

SEQ ID NO: 789 - protein, 24 aa, Hippoglossus sp.
FLGLLFHGVHHVGKWIHGLIHGHH

SEQ ID NO: 790 - protein, 44 aa, Heliothis virescens
DKLIGSCVWGAVNYTSDCNGECLLRGYKGGHCGSFANVNCWCET

SEQ ID NO: 791 - protein, 30 aa, Myxine glutinosa
GWFKKAWRKVKNAGRVLKGVGIHYGVGLIG

SEQ ID NO: 792 - protein, 38 aa, Myxine glutinosa
GWFKKAWRKVKHAGRRVLDTAKGVGRHYLNNWLNRYRG

SEQ ID NO: 793 - protein, 25 aa, Pan troglodytes
DTHFPICIFCCGCCHRSKCGMCCKT

SEQ ID NO: 794 - protein, 25 aa, Pongo pygmaeus
DTHFPICIFCCGCCHRSKCGMCCKT

SEQ ID NO: 795 - protein, 25 aa, Gorilla gorilla
DTHFPICIFCCGCCHRSKCGMCCKT

SEQ ID NO: 796 - protein, 25 aa, Nomascus concolor
DTHFPICIFCCGCCHRSKCGMCCKT

SEQ ID NO: 797 - protein, 25 aa, Hylobates lar
DTHFPICIFCCGCCHRSKCGMCCKT

SEQ ID NO: 798 - protein, 25 aa, Papio papio
DTHFPICIFCCGCCHRSKCGMCCRT

SEQ ID NO: 799 - protein, 25 aa, Presbytis obscura
DTHFPICIFCCGCCHRSKCGMCCRT

SEQ ID NO: 800 - protein, 25 aa, Presbytis melalophos
DTHFPICIFCCGCCHRSKCGMCCRT

SEQ ID NO: 801 - protein, 25 aa, Presbytis cristata
DTHFPICIFCCGCCHRSKCGMCCRT

SEQ ID NO: 802 - protein, 25 aa, Macaca fuscata
DTHFPICIFCCGCCHRSKCGMCCRT

SEQ ID NO: 803 - protein, 25 aa, Macaca fascicularis
DTHFPICIFCCGCCHRSKCGMCCRT

SEQ ID NO: 804 - protein, 25 aa, Chlorocebus aethiops
DTHFPICIFCCGCCHRSKCGMCCRT

SEQ ID NO: 805 - protein, 25 aa, Sus scrofa
DTHFPICIFCCGCCRKAICGMCCKT

SEQ ID NO: 806 - protein, 25 aa, Ateles fusciceps
DTHFPICIFCCGCCRQPNCGMCCKT

SEQ ID NO: 807 - protein, 25 aa, Callithrix jacchus
DTHFPICIFCCGCCRQSNCGMCCKT

SEQ ID NO: 808 - protein, 25 aa, Pongo abelii
DTHFPIYIFCCGCCHRSKCGMCCKT

SEQ ID NO: 809 - protein, 25 aa, Mus musculus
DTNFPICIFCCKCCNNSQCGICCKT

SEQ ID NO: 810 - protein, 25 aa, Rattus norvegicus
DTNFPICLFCCKCCKNSSCGLCCIT

SEQ ID NO: 811 - protein, 96 aa, Ictalurus punctatus
MRPMSIACAVAVIIACVCALQSAALPSEVRLDPEVRLEEPEDSEAARSIDQGVAAALAKETSPEVLFRTKRQSHLSLCRYCCNCCKNKGCGFCCRF

SEQ ID NO: 812 - protein, 59 aa, Canis lupus
  Canis lupus familiaris
PHQTGQLTDLRAQDTAGAEAGLQPTLQLRRLRRRDTHFPICIFCCGCCKTPKCGFCCKT

SEQ ID NO: 813 - protein, 59 aa, Canis lupus
  Canis lupus familiaris
PHQTGQLTDLRAQDTAGAEAGLQPTLQLRRLRRRDTHFPICIFCCGCCKTPKCGLCCIT

SEQ ID NO: 814 - protein, 59 aa, Canis lupus
  Canis lupus familiaris
PHQTGQLTDLRAQDTAGAEAGLQPTLQLRRLRRRDTHFPICIFCCGCCKTPKCGLCCKT

SEQ ID NO: 815 - protein, 56 aa, Bos taurus
PPQTRQLTDLQTKDTAGAAAGLTPVLQRRRRDTHFPICIFCCGCCRKGTCGMCCRT

SEQ ID NO: 816 - protein, 25 aa, Danio rerio
QSHLSLCRFCCKCCRNKGCGYCCKF

SEQ ID NO: 817 - protein, 85 aa, Pagrus major
MKTFSVAVAVAVVLTFICLQESSAVSFTEVQELEEPMSNGSPVAAYEEMSEESWKMPYASRRWRCRFCCRCCPRMRGCGLCCQRR

SEQ ID NO: 818 - protein, 86 aa, Equus caballus
MALNTNIRAACLLLLLLASLTSGSVLPHQTRQLADLQTQDAAGMAGAAAGLMPGLHQLRRRDTHFPICTLCCGCCNKQKCGWCCKT

SEQ ID NO: 819 - protein, 86 aa, Equus caballus; identical to SEQ ID NO: 818

SEQ ID NO: 820 - protein, 20 aa, Danio rerio
LCRFCCKCCRNKGCGYCCKF

SEQ ID NO: 821 - protein, 54 aa, Mus musculus
QMRQTTELQPLHGEESRADIAIPMQKRRKRDINFPICRFCCQCCNKPSCGICCE

SEQ ID NO: 822 - protein, 25 aa, Salmo salar
QIHLSLCGLCCNCCHNIGCGFCCKF

SEQ ID NO: 823 - protein, 25 aa, Mus musculus
DINFPICRFCCQCCNKPSCGICCEE

SEQ ID NO: 824 - protein, 20 aa, Homo sapiens
ICIFCCGCCHRSKCGMCCKT

SEQ ID NO: 825 - protein, 25 aa, Homo sapiens
DTHFPICIFCCGCCHRSKCGMCCKT

SEQ ID NO: 826 - protein, 21 aa, Lateolabrax japonicus
DCRFCCGCCTDVSGCGVCCRF

SEQ ID NO: 827 - protein, 299 aa, Euonymus europaeus
QQCGRQAGNRRCANNLCCSQYGYCGRTNEYCCTSQGCQSQCRRCGVRTVGEIVVGDIGGIISKGMFNNILKHRDDDACEGKGFYTYEAFVAAARSFPAFGSTGDDATRKREIAAFLAQTSHETSAGWPSAPDGPYAWGYCFVRERNPPSKYCDTTTPCPKSYYGRGPIQLTWNYNYEQAGRAIGADLLNNPDLVATDAVISFKTAIWFWMTAQSSKPSCHDVITGSWRPSASDNSVCHVPDYAVVTNIISGEIEYGKSRNPQVEDRIEFFKRYCQILGVSPGKCYEERTFVSGLMMETI

SEQ ID NO: 828 - protein, 38 aa, Myxine glutinosa
GFFKKAWRKVKHAGRRVLDTAKGVGRHYVNNWLNRYRZ

SEQ ID NO: 829 - protein, 31 aa, Myxine glutinosa
GWFKKAWRKVKNAGRRVLKGVGIHYGVGLIZ

SEQ ID NO: 830 - protein, 84 aa, Hadrurus gertschi
GILREKYAHKAIDVLTPMIGVPVVSKIVNNAAKQLVHKIAKNQQLCMFNKDVAGWCEKSCQQSAHQKGYCHGTKCKCGIPLNYK

SEQ ID NO: 831 - protein, 24 aa, Homo sapiens
DSHAKRHHGYKRKFHEKHHSHRGY

SEQ ID NO: 832 - protein, 12 aa, Oncorhynchus mykiss
AERVGAGAPVYL

SEQ ID NO: 833 - protein, 20 aa, Ictalurus punctatus
  MOD_RES (19)..(19): Any amino acid
PDPAKTAPKKGSKKAVTKXA

SEQ ID NO: 834 - protein, 17 aa, Ictalurus punctatus
PDPAKTAPKKKSKKAVT

SEQ ID NO: 835 - protein, 37 aa, Hylobates sp.
SLGNFFRKARKKIGEEFKRIVQRIKDFLQHLIPRTEA

SEQ ID NO: 836 - protein, 84 aa, Holotrichia diomphalia
YGPGDGHGGGHGGGHGGGHGNGQGGGHGHGPGGGFGGGHGGGHGGGGRGGGGSGGGGSPGHGAGGGYPGGHGGGHHGGYQTHGY

SEQ ID NO: 837 - protein, 128 aa, Hordeum vulgare
QYSVGGGYNDVGGGGGSQQCPQERPNLGSCKDYVMERCFTMKDFPLTWPTKWWKGGCEQEVREKCCQQLSQIAPQCRCDAIRGVIQGKLGGIFGIGGGDVFKQIQRAQILPSKCNMGADCKFPSGYYW

SEQ ID NO: 838 - protein, 36 aa, Unknown; identical to SEQ ID NO: 468
  Description of Unknown: Anti-microbial peptide

SEQ ID NO: 839 - protein, 45 aa, Hyas araneus
MRLLWLLVAMVVTVLAAATPTAAWQRPLTRPRPFSRPRPYRPNYG

SEQ ID NO: 840 - protein, 14 aa, Hypsiboas punctatus
GILDAIKAIAKAAG

SEQ ID NO: 841 - protein, 19 aa, Hypsiboas lundii
FIGAILPAIAGLVHGLINR

SEQ ID NO: 842 - protein, 19 aa, Hypsiboas lundii
FIGAILPAIAGLVGGLINR

SEQ ID NO: 843 - protein, 12 aa, Phyllomedusa azurea
LRPAVIVRTKGK

SEQ ID NO: 844 - protein, 14 aa, Phyllomedusa azurea
FRPALIVRTKGTRL

SEQ ID NO: 845 - protein, 66 aa, Lactococcus lactis
KRSFTEYTQVIETVSKNKVFLEQLLLANPKLYDVMQKYNAGLLKKKRVKKLFESIYKYYKRSYLRS

SEQ ID NO: 846 - protein, 233 aa, Micromonospora echinospora
PDFMIAASDADAVVRGEFTPVLGELHLGVNSLDYAYFARLHPHRDDLLREVDLDFPRPRLLVMAPMEAGANLVPRTQRALVRPQDHLVALTSRVPFPTRGRPLNGADLTVAEQPDGWEIRVPGGERFDLMEIFAQPLKTALMARVSFFRDEHLPRISFGRLVVVREQWRIAADELAFAAVRDTRDRYVHARRWWRRRDLPTRVFVKSPLERKPFHVDADSPALVELLCAAVRR

SEQ ID NO: 847 - protein, 152 aa, Chaetomium globosum
  CBS 148.51
PSVVDQIAKVEDILKRLNLIKRERIQVLKDLKEKILILNKKSIANYEQQLFQQELEKYRGFQNRLVQATHKQAALMRELTVAFNGLLQDKRVRAEQSKYESFQRQRGAVIGRYKRAYQEFLDLEAGLQSAKTWYKEMKETVESLEKNVETFV

SEQ ID NO: 848 - protein, 34 aa, Macaca fascicularis
RIVDCKRSEGFCQEYCNYLETQVGYCSKKKDACC

SEQ ID NO: 849 - protein, 121 aa, Bacillus cereus
  ATCC 14579
NNVFQNKEKNYYEAFYTEEKFKKALKVTTPEAYKSLVDLNIQKDSLNRARYGYIQRATVKTSPLSYFGKTTYYSLNKKDSEETLQLNNVVKYLILTAAMNDVEVMNLLRIKINPVFKKINN

SEQ ID NO: 850 - protein, 121 aa, Bacillus cereus; identical to SEQ ID NO: 849
  ATCC 14579

SEQ ID NO: 851 - protein, 255 aa, Unknown
  Description of Unknown: Anti-microbial peptide
MNNLHRELAPIASAAWEQIEEEVARTFKRSVAGRRVVDVEGPKGPALSAVGTGHLRDVDAPREQVSARLREVRAIVELTVPFELSRDAIDSVERGARDADWQPAKDAAQRLAFAEDHAIFDGYAAAGIIGIREGSSNRRLTLPDDVGAYPDAISDALEALRLAGVDGPYSVLLGADAYTALSEARDQGYPVIDHIKRIVSGEIIWAPAISGGCVLSTRGGDYELHLGEDVSIGYTSHTDKVVRLYLRETFTFLML

SEQ ID NO: 852 - protein, 259 aa, Burkholderia xenovorans
  LB400
MNNLHRELAPISRAAWSQIEDEVARTFRRSVAGRRVVDVKGPGGTELSGVGTGHQTAIAAPQQGVVAKLSEVKSLVELTVPFELQREAIDSVVRGAKDADWQPAKEAAKQLAYAEDRAIFDGYQAAGIGGIREGSSNPSLALPADVSDYPNAISNALEQLRLAGVDGPYSVLLGADAYTALGEARDQGYPVIEHIKRIVNGDIIWAPALAGGSVLSTRGGDFELHLGEDLSIGYTSHTDTVVRLYLRETLTFLMLTSEA

SEQ ID NO: 853 - protein, 104 aa, Legionella pneumophila
  subsp. pneumophila str. Ph
MSTPKWNLSISRAVICVIALFASMICAAAHFVGGIHTNAGYVGWYHPDYYNHDVIGVGNYHPGYGWVAPVYATPTYIIGNTGYNCQTVQQCDSEGNCIQSQNCD

SEQ ID NO: 854 - protein, 48 aa, Methylobacterium sp.
  4-46
CLASPSVFRRLTDPPGDARGRRRLAASLHRYLMRAVGRATPNGLWAGI

SEQ ID NO: 855 - protein, 152 aa, Nematostella vectensis
KNDAKSIIISEEDFKDVDFTNANLPHSFAIKFNVLNAETEKIQLDAIAGATANLLIGRFGHGNAAIAEIINEITEHEELQANDSILAEIVHLPESRIGNILSRPEMRNYEMAYLAKSNKENQFQIKISDLYVSVRNGNIILRSKALNKQIIP

SEQ ID NO: 856 - protein, 157 aa, Methanosarcina acetivorans
  C2A
IPLIWKDFTLDRRLYEAMRRKNTNVDASAALEAAYTVSSAEEMMILRGITRNGTTFEKNGLYEGAGQDYSTPKAIGTYGGIQDAVTDVYEMMDDSDVPTDSLRWNLSMSPNIYNKVNKSRSANDVKEMKDLLELLGTPNNPGNVFKSNTLPSVSTTG

SEQ ID NO: 857 - protein, 160 aa, Sulfolobus acidocaldarius
  DSM 639
RSDLPVNRTLNIIHRAGVKYSLMEDELLLSKHPLSIIERGRKEKASDWDIPGSIANDVIRGIQILETNGYTDPVTIISPELYTRLFRVYDKSGTYEIKLVKHATEIIVSPLIKGLAVVSKKGFYVMENTPAKVEFLGREGINSDYIIWGKIAPYLIDTNA

SEQ ID NO: 858 - protein, 223 aa, Salmonella enterica
  subsp. enterica serovar Kentu
HPDVVSYFMIHHDWKFDFFHYEKDGDIKGSYFLCNGKQIGIMARRSYPLSSDEVLIPFSPHARCFFPDKTNKLSIINKQNIINATWKIARKKQNCIIKESFSPKFEKTRRNEIQRFIRNGGEIKCISQLSDKEISSSYISLFHSRFGGTLPCYEYDNLLMFISHLRELMFGHVLFWDNKPCAIDIVLKSESSCNVYYDVPNGAVLNDENCMKLSPGSVLMWLN

SEQ ID NO: 859 - protein, 201 aa, Sulfolobus tokodaii
  str. 7
NIIKWDQQAIPFYETKVQDNAIIQSDKQVPYPLSIINTLFKVMPDLPKEETQPVFMKAYLTHSRKEDLLIYREHPLSILQRSKKMNRSDWNIPGNIVNDIVRAYEQVLSSGYSDVNLIIPPYVHALLYRVVDRTGTMEIELLRHLGNIYVSPNVDTIVVISKQVLYVYEKKSTTLENLGRDGVYEVYMLSSELAPYVTDPE

SEQ ID NO: 860 - protein, 20 aa, Impatiens balsamina
QWGRRCCGWGPGRRYCVRWC

SEQ ID NO: 861 - protein, 20 aa, Impatiens balsamina
QYGRRCCNWGPGRRYCKRWC

SEQ ID NO: 862 - protein, 20 aa, Impatiens balsamina
QYRHRCCAWGPGRKYCKRWC

SEQ ID NO: 863 - protein, 20 aa, Impatiens balsamina
QWGRRCCGWGPGRRYCRRWC

SEQ ID NO: 864 - protein, 23 aa, Ixodes sinensis
GLHKVMREVLGYERNSYKKFFLR

SEQ ID NO: 865 - protein, 32 aa, Ixodes sinensis
QLKVDLWGTRSGIQPEQHSSGKSDVRRWRSRY

SEQ ID NO: 866 - protein, 8 aa, Apis mellifera
PFKISIHL

SEQ ID NO: 867 - protein, 9 aa, Apis mellifera
TPFKISIHL

SEQ ID NO: 868 - protein, 29 aa, Oldenlandia affinis
VCGETCVGGTCNTPGCTCSWPVCTRNGLP

SEQ ID NO: 869 - protein, 227 aa, Homo sapiens
IINGSDCDMHTQPWQAALLLRPNQLYCGAVLVHPQWLLTAAHCRKKVFRVRLGHYSLSPVYESGQQMFQGVKSIPHPGYSHPGHSNDLMLIKLNRRIRPTKDVRPINVSSHCPSAGTKCLVSGWGTTKSPQVHFPKVLQCLNISVLSQKRCEDAYPRQIDDTMFCAGDKAGRDSCQGDSGGPVVCNGSLQGLVSWGDYPCARPNRPGVYTNLCKFTKWIQETIQANS

SEQ ID NO: 870 - protein, 21 aa, Kassina senegalensis
GFMKYIGPLIPHAVKAISDLI

SEQ ID NO: 871 - protein, 29 aa, Artificial Sequence
  Description of Artificial Sequence: Synthetic anti-microbial peptide
IEGRFKCRRWQWRMKKLGAPSITCVRRAF

SEQ ID NO: 872 - protein, 26 aa, Artificial Sequence
  Description of Artificial Sequence: Synthetic anti-microbial peptide
MFKCRRWQWRMKKLGAPSITCVRRAF

SEQ ID NO: 873 - protein, 18 aa, Artificial Sequence
  Description of Artificial Sequence: Synthetic anti-microbial peptide
PMFKCWRWQWRWKKLGAM

SEQ ID NO: 874 - protein, 69 aa, Bubalus bubalis
WQWRMKKLGAPCISCLRRAFALESIRAIPEKKADAVTLDDAMVFEAGRGCLRLRPVAAEMYGTKECIQS

SEQ ID NO: 875 - protein, 49 aa, Bothrops pirajai
ADDKNPLEEFRETNYEVFLEIAKNGLKATSNPKRVVIVGAGMAGLSAAY

SEQ ID NO: 876 - protein, 61 aa, Crotalus durissus
  Crotalus durissus cascavella
ADDRNPLEQCFRETDYEEFLEIARNNLKATSNPKHVVIVGAGMAGLSAAYVLSGGGHQVTV

SEQ ID NO: 877 - protein, 442 aa, Bacillus cereus
  NVH0597-99
KQIASKITIYQGKELQLFRKLVELKLLRQCITIPNNRGIITSIIQFLEEYEVGKEIIPLLEELHAALHSFEKSSSFERINDWNEIKRILSLLQKGDKKVGSEIIYEDVIFKDVRKDTITPKIRKSFLEGLADFILLFDVNVRVQYEIAQLFYEKYGKSTEKLSNSNLLNEVFFREIHQFYPYYQNQKYRYKEAKAKEIQQLDELRDQFLKEFESLILNVDQSVEVIDIELLIEKYTSLIPEYIKKDSNISYTLFLQETTDENIVLNNVYDGQEKFISRFKDFFMPHYETKEYSNYIERVLNEDNCYEVDELFGFNGGIHERKSHNIVNLDVGYQRFNHKDAKQVRDFKVRYNTERKKIEFLDDNYKICNLVYKSSLVPMFLPGILSVMLYLFQSGRLNFDITSLVKEENYVPRITFGNVVLSRKKWKVIMEDLKDILESKLE

SEQ ID NO: 878 - protein, 22 aa, Streptococcus mutans
FKSWSFCTPGCAKTGSFNSYCC

SEQ ID NO: 879 - protein, 20 aa, Bacillus sp.
  HIL Y-85,54728
  MOD_RES (2)..(2): Any amino acid
  MOD_RES (4)..(4): Any amino acid
  MOD_RES (13)..(13): Any amino acid
  MOD_RES (15)..(16): Any amino acid
  MOD_RES (20)..(20): Any amino acid
CXFXLPGGGGVCXLXXECIX

SEQ ID NO: 880 - protein, 24 aa, Lachesana tarabaevi
GLKDKFKSMGEKLKQYIQTWKAKF

SEQ ID NO: 881 - protein, 25 aa, Lachesana tarabaevi
SMWSGMWRRKLKKLRNALKKKLKGE

SEQ ID NO: 882 - protein, 26 aa, Lachesana tarabaevi
GLFGKLIKKFGRKAISYAVKKARGKH

SEQ ID NO: 883 - protein, 26 aa, Lachesana tarabaevi
GLFGKLIKKFGRKAISYAVKKARGKN

SEQ ID NO: 884 - protein, 20 aa, Lachesana tarabaevi
SWKSMAKKLKEYMEKLKQRA

SEQ ID NO: 885 - protein, 20 aa, Lachesana tarabaevi
SWASMAKKLKEYMEKLKQRA

SEQ ID NO: 886 - protein, 24 aa, Lachesana tarabaevi
GLKDKFKSMGEKLKQYIQTWKAKF

SEQ ID NO: 887 - protein, 24 aa, Lachesana tarabaevi
SLKDKVKSMGEKLKQYIQTWKAKF

SEQ ID NO: 888 - protein, 28 aa, Lachesana tarabaevi
GFFGKMKEYFKKFGASFKRRFANLKKRL

SEQ ID NO: 889 - protein, 46 aa, Hordeum vulgare
KSCCKDTLARNCYNTCRFAGGSRPVCAGACRCKIISGPKCPSDYPK

SEQ ID NO: 890 - protein, 40 aa, Homo sapiens
MTPFWRGVSLRPIGASCRDDSECITRLCRKRRCSLSVAQE

SEQ ID NO: 891 - protein, 30 aa, Pseudoplusia includens
PDFKLPGMKYPIPATTPPFVPKRSRFPIYA

SEQ ID NO: 892 - protein, 42 aa, Galleria mellonella
EADEPLWLYKGDNIERAPTTADHPILPSIIDDVKLDPNRRYA

SEQ ID NO: 893 - protein, 95 aa, Leonurus japonicus
MLQGRQFRSCQSYLRQRGNVLEMATGNPQSQTVEECCESLKDIERKQQQCGCEAIKHAMRQMQGGQSEEVYRKARMLPRTCGLRSQQCQFNVIFV

SEQ ID NO: 894 - protein, 46 aa, Phoradendron liga
KSCCPSTTARNIYNTCRLTGASRSVCASLSGCKIISGSTCDSGWNH

SEQ ID NO: 895 - protein, 36 aa, Bubalus bubalis
NPVSCARNKGICVPSRCPGNMRQIGTCLGPPVKCCR

SEQ ID NO: 896 - protein, 36 aa, Capra hircus
SRRSCHRNKGVCALTRCPRNMRQIGTCFGPPVKCCR

SEQ ID NO: 897 - protein, 36 aa, Bos taurus
NSQSCRRNKGICVPIRCPGSMRQIGTCLGAQVKCCR

SEQ ID NO: 898 - protein, 40 aa, Bos taurus
VRNSQSCRRNKGICVPIRCPGSMRQIGTCLGAQVKCCRRK

SEQ ID NO: 899 - protein, 260 aa, Wolinella succinogenes
  DSM 1740
MDILRRENAQFPASIWSAIEKEAGLVFGKHLTGRKVVDFKGGLGIGFSSLPTGRVISSKEKLGEASVGVRMNTPVIELKIPFSFPESEVEAILREANAFDISSIEKAAKKVCVAENELVFYGLKKEGIEGLIPSIPHKPIKAKGDEILPAVAEGIKELVNSEIEGPYALLIQPQYFGKLFGVAGNSGYPLTLKLAELLQGNNIIVAPALKSGALLVSLRGGDYELYSGMDIGVGYSEKKSTNHELFFFETLTFRINTPEA

SEQ ID NO: 900 - protein, 266 aa, Rhodospirillum rubrum
  ATCC 11170
MNDLMRDLAPISAKAWAEIETEARGTLTVTLAARKVVDFKGPLGWDASSVSLGRTEALAEEPKAAGSAAVVTVRKRAVQPLIELCVPFTLKRAELEAIARGASDADLDPVIEAARAIAIAEDRAVFHGFAAGGITGIGEASAEHALDLPADLADFPGVLVRALAVLRDRGVDGPYALVLGRTVYQQLMETTTPGGYPVLQHVRRLFEGPLIWAPGVDGAMLISQRGGDFELTVGRDFSIGYHDHDAQSVHLYLQESMTFRCLGPEA

SEQ ID NO: 901 - protein, 259 aa, Burkholderia ubonensis
  Bu
MNNLHRELAPISAAAWAQIEEEVARTFKRSVAGRRVVDVEEPGGVELSGVGTGHLHTIAAPRERVGAKLREVKALVEFTVPFELRRDAIDAVERGARDADWQPAKDAAQRLAFVEDSAIFDGYPAAGIVGIREATSNRKIALPSDVGAYPGAIGDAVEALRLAGVDGPYSVLLGADAYTALAEAREHGYPVLDHIKRIVSGEIVWAPALSGGCVLSTRGGDFALHLGEDVSIGYRSHNDEVVHLYLRETFTFLMLTSEA

SEQ ID NO: 902 - protein, 226 aa, Pyrobaculum calidifontis
  JCM 11548
PQDEWAELREAARQAADSIRVFRRYIPTTRVGRGVEYVPVEREGVRDAVKLVEISAKFKISQAALDYAKRTGQPLDAGDALRAAAELALEEDRLVAHTLLNLSNALKMAATSWDEPGKAVAEVSKAVAELIKAGAPGPYILFVDPARFAKLVSVYEKTGVMELTRIKAIVKDVVPTPVVPPSAALLISASPQTLDLVIGADTEVEYLGPEDGKHLFRLWETIAVRV

SEQ ID NO: 903 - protein, 259 aa, Paracoccus denitrificans
  PD1222
MDNLHRKLAPISDAAWAQIEDEAARTLKRYLGARRVVDVHGPEGFGLSAVGTGHLRPATALAEGVESHRREVNPLLELRVPFTLTRAAIDDVARGSNDSDWQPLKDAARKIALAEDRLVFLGHGDAGIRGILPETSNPIVALPANVADYPEAVASAVSELRLAGVNGPYALILGTTAFTAANGGAEDGYPVLKHLERLVDVPVVWSQALEGGAVVTTRGGDFDLWLGQDISIGYLSHDAASVTLYLQESLTFQMQTSEA

SEQ ID NO: 904 - protein, 259 aa, Burkholderia ambifaria
  AMMD
MNNLHRELAPIASSAWAQIEEEVARTFKRSVAGRRVVDVEGPAGPGLSAVGTGHLRDVTAPREQVSARLREVRNVVELTVPFELSRDAIDSVERGARDADWQPAKDAAQRLAFAEDGAIFDGYLAADIVGIREGTSNRKLILPTDVSAYPDAISDALEALRLAGVDGPYTVVLGSDAYTALSEARDQGYPVLGHIKRIVSGEIVWAPAISGGCVLSTRGGDYELHLGEDVSIGYTSHTDKVVRLYLRETFTFLMLTSEA

SEQ ID NO: 905 - protein, 259 aa, Burkholderia ambifaria
  MC40-6
MNNLHRELAPIASSAWAQIEEEVARTFKRSVAGRRVVDVEGPAGPGLSAVGTGHLRDVTAPREQVSARLREVRNVVELTVPFELSRDAIDSVERGARDADWQPAKDAAQRLAFAEDGAIFDGYLAADIVGIREGTSNRKLTLPTDVSAYPDAISDALEALRLAGVDGPYTVVLGSDAYTALSEARDQGYPVLGHIKRIVSGEIVWAPAISGGCVLSTRGGDYELHLGEDVSIGYTSHTDKVVRLYLRETFTFLMLTSEA

SEQ ID NO: 906 - protein, 259 aa, Burkholderia cenocepacia
  HI2424
MNNLHRELAPISSAAWEQIEEEVARTFKRSVAGRRVVDVEGPAGPELSAVGTGHLLDVAAPRELVNARLREVRTIVELTVPFELSRDAIDSVERGARDADWQPAKEAAQRLAFAEDNAIFDGYPAAGIVGIREGTSNRRLTLPADVGAYPDAISDALEALRLAGVDGPYSVVLGSDAYTALSEARDQGYPVLGHIKRIVSGEIIWAPAISGGCVLSTRGGDYELHLGEDVSIGYTSHTDKGVRLYLRETFTFLMLTSEA

SEQ ID NO: 907 - protein, 259 aa, Burkholderia cenocepacia; identical to SEQ ID NO: 906
  AU 1054

SEQ ID NO: 908 - protein, 259 aa, Burkholderia phymatum
  STM815
MNNLHRELAPISSEAWSQIEEEVARTFKRSVAGRRVVDVKGPGGVDLSGVGTGHQSTIAAPHHGVIAKLSEVKALVQLTVPFELSRDAIDAVERGANDSDWQAAKDAAKELAYAEDRAIFDGYKAAGIVGIREGSSNTSLALPADVADYPNAIGGALQQLRLAGVDGPYSVLLGADAYTALGEASDQGYPVIEHIKRIVNGEIIWAPALEGGSVLSMRGGDYELHLGQDVSIGYQSHTDSTVRLYLRETLTFLMLTSEA

SEQ ID NO: 909 - protein, 259 aa, Burkholderia sp.
  383
MNNLHRELAPISSSAWEQIEEEVARTFKRSVAGRRVVDVDGPEGPELSAVGTGHLVEVAAPREQVNARLREVRTIVELTVPFELSRDAIDSVERGARDADWQPAKDAAQRLAFAEDGAIFDGYAAASIVGIREGTSNNKLTLPADVSAYPDAISDALEALRLAGVDGPYSVVLGSDAYTALSEARDQGYPVLGHIKRIVSGEIIWAPAISGGCVLSTRGGDYELHLGEDVSIGYTSHTDKVVRLYLRETFTFLMLTSEA

SEQ ID NO: 910 - protein, 259 aa, Burkholderia vietnamiensis
  G4
MNNLHRELAPVSASAWQQIEEEVARTFKRSVAGRRVVDVEGPAGPALSAVGTGHLCDVAAPRELVSARLREVRTIVELTVPFELSRDAIDSVERGARDADWQPAKDAAQRLAFAEDGAIFDGYAAAGIVGIREGTSNRKLALPADVSAYPDAISDALEALRLAGVDGPYSVVLGSDAYTALSEARDQGYPVLGHIKRIVSGEIIWAPAISGGCVLSTRGGDYELHLGEDVSIGYTSHTDKVVRLYLRETLTFLMLTGEA

SEQ ID NO: 911 - protein, 236 aa, Burkholderia phytofirmans
  PsJN
ARTFKRSVAGRRVVDVEGPGGTELSGVGTGHQTAIAAPQQGVVARLAEVKRLVEFTVPFELQREAIDSVLRGANDADWQPAKDAAKELAYAEDRAIFDGYQAAGIGGIREGSSNAPLALPADIGDYPHAIGNALEELRLAGVDGPYSVLLGADAYTALSEARDQGYPVIEHIKRIVNGDIIWAPALTGGSVLSTRGGDFELHLGEDLSIGYLSHTDSVVRLYLRETLTFLMLTSEA

SEQ ID NO: 912 - protein, 255 aa, Unknown
  Description of Unknown: Anti-microbial peptide
MNNLHRELAPISSAAWEQIEEEVARTFKRSVAGRRVVDVEGPAGPELSAVGTGHLLDVAAPRELVNARLREVRTIVELTVPFELSRDAIDSVERGARDADWQPAKEAAQRLAFAEDNAIFDGYPAAGIVGIREGTSNRRLTLPADVGAYPDAISDALEALRLAGVDGPYSVVLGSDAYTALSEARDQGYPVLGHIKRIVSGEIIWAPAISGGCVLSTRGGDYELHLGEDVSIGYTSHTDKGVRLYLRETFTFLML

SEQ ID NO: 913 - protein, 78 aa, Pelteobagrus fulvidraco
LAAWCLVIMVLSQQVASSPVPVMEILSGSVQGVQRSLRRMARMTPLWRIVGTKPHGAYCQNNYECSTGICRKGHCSFS

SEQ ID NO: 914 - protein, 44 aa, Gallus gallus
RLKRMTPFWRGVSLRPVGASCRDNSECITMLCRKNRCFLRTASE

SEQ ID NO: 915 - protein, 78 aa, Ctenopharyngodon idella
LLAWCLVFLVIVQQVTSSPVPQSDTPLTSVQEVQRSLKRTARMTPLWRIMGTKPHGAYCQNHYECSTGICRKGHCSYS

SEQ ID NO: 916 - protein, 73 aa, Ictalurus punctatus
LVLMVLAQQVAPSPVREIEAALGSLQGVQRSLRRMARMTPLWRIMGTKPHGAYCQNNYECSTGICRKGHCSFS

SEQ ID NO: 917 - protein, 41 aa, Paralichthys olivaceus
RRVARMTPLWRIMSSKPFGAYCQNNYECSTGLCRAGHCSTS

SEQ ID NO: 918 - protein, 40 aa, Bos taurus
MTPFWRAVSLRPIGASCRDDSECITRLCRKRRCSLSVAQE

SEQ ID NO: 919 - protein, 40 aa, Sus scrofa
MTPFWRAVSLRPIGASCRDDSECLTRLCRKRRCSLSVAQE

SEQ ID NO: 920 - protein, 40 aa, Cavia porcellus
MTPFWRGVSLRPIGASCRDDSECITRLCKKRRCSLSVAQE

SEQ ID NO: 921 - protein, 40 aa, Macaca mulatta; identical to SEQ ID NO: 890

SEQ ID NO: 922 - protein, 40 aa, Mus musculus; identical to SEQ ID NO: 890

SEQ ID NO: 923 - protein, 65 aa, Oncorhynchus mykiss
SPIGSHDSRLSLQQGTKLLERRTRMTPLWRFMGTKPTGAYCRDHFECSTQICRRGHCALSGAVHS

SEQ ID NO: 924 - protein, 53 aa, Oncorhynchus mykiss
PEGQRALKRMARMTPLWRTMGTKPYGAYCLNNYECSTGICRGGHCMFSQPIKS

SEQ ID NO: 925 - protein, 77 aa, Oncorhynchus mykiss
GVCLVALILMHQVCASPIGSHDSRLSLQQGTKLLERRTRMTPLWRFMGTKPTGAYCRDHFECSTQICRRGHCALSGA

SEQ ID NO: 926 - protein, 77 aa, Oncorhynchus mykiss; identical to SEQ ID NO: 925

SEQ ID NO: 927 - protein, 23 aa, Rana livida
LPFVAGVAAEMMQHVYCAASKKC

SEQ ID NO: 928 - protein, 75 aa, Rana livida
MFTMKKSLLLLFFLGTISLSLCEEERDADEDEGEMTEEEVKRSVLGTVKDLLIGAGKSAAQSVLTALSCKLSNSC

SEQ ID NO: 929 - protein, 66 aa, Rana livida
MFTMKKSLLLLFFLGIINLSLCQEERNAEEERRDEEVAKAEEIKRGILSGILGVGKKLVCGLSGLC

SEQ ID NO: 930 - protein, 33 aa, Odorrana schmackeri
SFLDTVKNMALNAAKSAGVSVLKTLSCKLSKEC

SEQ ID NO: 931 - protein, 13 aa, Unknown
  Description of Unknown: Anti-microbial peptide
  MOD_RES (13)..(13): Any amino acid
FKRIVQRIKDFLX

SEQ ID NO: 932 - protein, 13 aa, Unknown
  Description of Unknown: Anti-microbial peptide
RLFDKIRQVIRKF

SEQ ID NO: 933 - protein, 456 aa, Homo sapiens
CQELLETVGTLARIDKDELGKAIQNSLVGEPILQNVLGSVTAVNRGLLGSGGLLGGGGLLGHGGVFGVVEELSGLKIEELTLPKVLLKLLPGFGVQLSLHTKVGMHCSGPLGGLLQLAAEVNVTSRVALAVSSRGTPILILKRCSTLLGHISLFSGLLPTPLFGVVEQMLFKVLPGLLCPVVDSVLGVVNELLGAVLGLVSLGALGSVEFSLATLPLISNQYIELDINPIVKSVAGDIIDFPKSRAPAKVPPKKDHTSQVMVPLYLFNTTFGLLQTNGALDMDITPELVPSDVPLTTTDLAALLPEALGKLPLHQQLLLFLRVREAPTVTLHNKKALVSLPANIHVLFYVPKGTPESLFELNSVMTVRAQLAPSATKLHISLSLERLSVKVASSFTHAFDGSRLEEWLSHVVGAVYAPKLNVALDVGIPLPKVLNINFSNSVLEIVENAVVLTVAS

SEQ ID NO: 934 - protein, 575 aa, Homo sapiens
MLQQSDALHSALREVPLGVGDIPYNDFHVRGPPPVYTNGKKLDGIYQYGHIETNDNTAQLGGKYRYGEILESEGSIRDLRNSGYRSAENAYGGHRGLGRYRAAPVGRLHRRELQPGEIPPGVATGAVGPGGLLGTGGMLAADGILAGQGGLLGGGGLLGDGGLLGGGGVLGVLGEGGILSTVQGITGLRIVELTLPRVSVRLLPGVGVYLSLYTRVAINGKSLIGFLDIAVEVNITAKVRLTMDRTGYPRLVIERCDTLLGGIKVKLLRGLLPNLVDNLVNRVLADVLPDLLCPIVDVVLGLVNDQLGLVDSLIPLGILGSVQYTFSSLPLVTGEFLELDLNTLVGEAGGGLIDYPLGWPAVSPKPMPELPPMGDNTKSQLAMSANFLGSVLTLLQKQHALDLDITNGMFEELPPLTTATLGALIPKVFQQYPESCPLIIRIQVLNPPSVMLQKDKALVKVLATAEVMVSQPKDLETTICLIDVDTEFLASFSTEGDKLMIDAKLEKTSLNLRTSNVGNFDIGLMEVLVEKIFDLAFMPAMNAVLGSGVPLPKILNIDFSNADIDVLEDLLVLSA

SEQ ID NO: 935 - protein, 51 aa, Arabidopsis thaliana
QKLCEKPSGTWSGVCGNSNACKNQCINLEGAKHGSCNYVFPAHKCICYVPC

SEQ ID NO: 936 - protein, 29 aa, Lumbricus rubellus
RQKDKRPYSERKNQYTGPQFLYPPERIPP

SEQ ID NO: 937 - protein, 18 aa, Lycosa singoriensis
GKLQAFLAKMKEIAAQTL

SEQ ID NO: 938 - protein, 18 aa, Lycosa singoriensis
GRLQAFLAKMKEIAAQTL

SEQ ID NO: 939 - protein, 26 aa, Lycosa singoriensis
KIKWFKTMKSLAKFLAKEQMKKHLGE

SEQ ID NO: 940 - protein, 25 aa, Hogna carolinensis
IWLTALKFLGKHAAKHLAKQQLSKL

SEQ ID NO: 941 - protein, 27 aa, Hogna carolinensis
KIKWFKTMKSIAKFIAKEQMKKHLGGE

SEQ ID NO: 942 - protein, 117 aa, Ostrea edulis
ISDACLTCICKQESYGCTQIGCRMDGRSLSCGYFQIKKSYWIDCGRLGSSWEACADDYNCAVRCVRAYMKKYIGKSGCTANCKNYARLHNGGPKGCTKPSTLTYWNAVKNQGCSINS

SEQ ID NO: 943 - protein, 36 aa, Pseudoplusia includens
RWKFFKKIEKVGQNIRDGIIKAGPAVAVVGQAAAIS

SEQ ID NO: 944 - protein, 117 aa, Crassostrea gigas
TISSACLRCICNVESGCRPIGCHYDVYSYSCGYFQIKENYWEDCGKPGTSFKACANDYTCASNCVRAYMKRYIGSSGCPANCESYARIHNGGPRGCRHPSTLRYWEKVHQQGCNVNS

SEQ ID NO: 945 - protein, 23 aa, Xenopus laevis
GIGKFLHSAKKFGKAFVGEIMNS

SEQ ID NO: 946 - protein, 23 aa, Artificial Sequence
  Description of Artificial Sequence: Synthetic anti-microbial peptide
GIGKYLHSAKKFGKAWVGEIMNS

SEQ ID NO: 947 - protein, 66 aa, Capra hircus
SYREAVLRAVDQFNERSAEANLYRLLELDPPPEQDAEDQGARKPVSFRVKETVCPRTSQQPVEQCD

SEQ ID NO: 948 - protein, 14 aa, Vespa magnifica
INWKGIAAMAKKLL

SEQ ID NO: 949 - protein, 13 aa, Vespa magnifica
INWKGIAAMKKLL

SEQ ID NO: 950 - protein, 15 aa, Vespa magnifica
INLKAIAALAKKLLG

SEQ ID NO: 951 - protein, 14 aa, Vespa magnifica
INLKAIAAMAKKLL

SEQ ID NO: 952 - protein, 27 aa, Bombina maxima
GIGTKILGGVKTALKGALKELASTYAN

SEQ ID NO: 953 - protein, 27 aa, Bombina maxima
GIGTKILGGVKTALKGALKELASTYVN

SEQ ID NO: 954 - protein, 27 aa, Bombina maxima
GIGGKILSGLKTALKGAAKELASTYLH

SEQ ID NO: 955 - protein, 27 aa, Bombina maxima
GIGGVLLSAGKAALKGLAKVLAEKYAN

SEQ ID NO: 956 - protein, 27 aa, Bombina maxima
SIGAKILGGVKTFFKGALKELASTYLQ

SEQ ID NO: 957 - protein, 20 aa, Bombina maxima
ILGPVISTIGGVLGGLLKNL

SEQ ID NO: 958 - protein, 20 aa, Bombina maxima
LLGPVLGLVSNALGGLLKNI

SEQ ID NO: 959 - protein, 20 aa, Bombina maxima
ILGPVLSMVGSALGGLIKKI

SEQ ID NO: 960 - protein, 20 aa, Bombina maxima
ILGPVLGLVGNALGGLIKKI

SEQ ID NO: 961 - protein, 20 aa, Bombina maxima
ILGPVISKIGGVLGGLLKNL

SEQ ID NO: 962 - protein, 25 aa, Bombina maxima
GIGGALLSAGKAALKGLAKGFAEHF

SEQ ID NO: 963 - protein, 27 aa, Bombina maxima
GIGGALLSAGKSALKGLAKGLAEHFAS

SEQ ID NO: 964 - protein, 27 aa, Bombina maxima
GIGTKIIGGLKTAVKGALKELASTYVN

SEQ ID NO: 965 - protein, 27 aa, Bombina maxima
GIGGALLSAGKSALKGLAKGLAEHFAN

SEQ ID NO: 966 - protein, 27 aa, Bombina maxima
GIGAKILGGVKTALKGALKELASTYVN

SEQ ID NO: 967 - protein, 27 aa, Bombina maxima
GIGTKILGGLKTAVKGALKELASTYVN

SEQ ID NO: 968 - protein, 27 aa, Bombina maxima
GIGRKFLGGVKTTFRCGVKDFASKHLY

SEQ ID NO: 969 - protein, 20 aa, Bombina maxima
ILGPVLGLVSNALGGLLKNL

SEQ ID NO: 970 - protein, 20 aa, Bombina maxima
ILGPVLGLVGSALGGLIKKI

SEQ ID NO: 971 - protein, 20 aa, Bombina maxima
ILGPVIKTIGGVLGGLLKNL

SEQ ID NO: 972 - protein, 20 aa, Bombina maxima
ILGPVLGLVGEPLGGLIKKI

SEQ ID NO: 973 - protein, 20 aa, Bombina maxima
ILGPVLGLVGNALGGLLKNL

SEQ ID NO: 974 - protein, 20 aa, Bombina maxima
ILGPVLSLVGNALGGLIKKI

SEQ ID NO: 975 - protein, 20 aa, Bombina maxima
ILGPVIGTIGNVLGGLLKNL

SEQ ID NO: 976 - protein, 20 aa, Bombina maxima
ILGPVIKTIGGVIGGLLKNL

SEQ ID NO: 977 - protein, 20 aa, Bombina maxima
ILGPVLGLVSNALGGLLKNI

SEQ ID NO: 978 - protein, 20 aa, Bombina maxima
ILGPVLGLVSNALGGLIKKI

SEQ ID NO: 979 - protein, 20 aa, Bombina maxima
ILGPVLSLVGSALGGLIKKI

SEQ ID NO: 980 - protein, 20 aa, Bombina maxima
ILGPVLGLVSNAIGGLIKKI

SEQ ID NO: 981 - protein, 25 aa, Bombina maxima
GIGGALLSAGKSALKGLAKGFAEHF

SEQ ID NO: 982 - protein, 27 aa, Bombina maxima
GIGGALLSAGKSALKGLAKGLVEHFAN

SEQ ID NO: 983 - protein, 119 aa, Cavia porcellus
TRGYVMVGSARTFNEAQWVCQRCYRGNLASIHSFAFNYQVQCTSAGLNVAQVWIGGQLRGKGRCRRFVWVDRTVWNFAYWARGQPWGGRQRGRCVTLCARGGHWRRSHCGKRRPFVCTY

SEQ ID NO: 984 - protein, 63 aa, Megoura viciae
YLDVKQLANYLLCIGNGQVFNGRKTCQIGCRAVCQQPGCSGYKECEQIPNIRLHKYRCHCNEA

SEQ ID NO: 985 - protein, 63 aa, Megoura viciae
YLDVNQIASYLLCLGQGAVFNGRKTCQIGCRAACQQPGCGGYKECEQIPNIRLHKYRCHCNSG

SEQ ID NO: 986 - protein, 63 aa, Megoura viciae
YLDVNQIASYLLCLGEGAVFNGRKTCQIGCRAACQQPGCGGYKECEQIPNIRLHKYRCHCISG

SEQ ID NO: 987 - protein, 26 aa, Apis mellifera
GIGAVLKVLTTGLPALISWIKRKRQQ

SEQ ID NO: 988 - protein, 22 aa, Rana temporaria
FIGSALKVLAGVLPSIVSWVKQ

SEQ ID NO: 989 - protein, 13 aa, Mesobuthus eupeus
IFGAIAGLLKNIF

SEQ ID NO: 990 - protein, 18 aa, Mesobuthus eupeus
FFGHLFKLATKIIPSLFQ

SEQ ID NO: 991 - protein, 88 aa, Escherichia coli
ASGRDIAMAIGTLSGQFVAGGIGAAAGGVAGGAIYDYASTHKPNPAMSPSGLGGTIKQKPEGIPSEAWNYAAGRLCNWSPNNLSDVCL

SEQ ID NO: 992 - protein, 74 aa, Escherichia coli
AGDPLADPNSQIVRQIMSNAAWGPPLVPERFRGMAVGAAGGVTQTVLQGAAAHMPVNVPIPKVPMGPSWNGSKG

SEQ ID NO: 993 - protein, 90 aa, Rhipicephalus microplus
HHQELCTKGDDALVTELECIRLRISPETNAAFDNAVQQLNCLNRACAYRKMCATNNLEQAMSVYFTNEQIKEIHDAATACDPEAHHEHDH

SEQ ID NO: 994 - protein, 55 aa, Bos indicus x Bos Taurus
GCVWPDGKAITTHKLQTTMLETKALIMGYFKSIATGGAMMAKPQEQLTPVIYPAV

SEQ ID NO: 995 - protein, 55 aa, Bos indicus x Bos Taurus
GCVWPDGKAITTHKLQTTMLETKALIMGYFKSIATGGAMMATQDGAVTPVIYPAV

SEQ ID NO: 996 - protein, 45 aa, Unknown
  Description of Unknown: Bos indicus x Bos Taurus polypeptide
MKALLILGLLLFSVAVQGKVFERCELARSLKRFGMDNFRGISLAN

SEQ ID NO: 997 - protein, 55 aa, Bos indicus x Bos Taurus
GCVWPDGKAITTHKLQTTMQETKALIMGYFKSIATGGAMMAKPQEQLTPVIYPAV

SEQ ID NO: 998 - protein, 45 aa, Bos indicus x Bos Taurus
MKALLILGLLLFSVAVQGKVFERCELARSLKRFGMDNFRGITLAN

SEQ ID NO: 999 - protein, 21 aa, Misgurnus anguillicaudatus
RQRVEELSKFSKKGAAARRRK

SEQ ID NO: 1000 - protein, 42 aa, Antheraea pernyi
AKIPIKAIKTVGKAVGKGLRAINIASTANDVFNFLEPKKRKH

SEQ ID NO: 1001 - protein, 43 aa, Spodoptera exigua
GKIPVKAIKKAGTAIGKGLRAINIASTAHDVYSFFKPKHKKKH

SEQ ID NO: 1002 - protein, 54 aa, Hyblaea puera
AMSLVSCSTAAPAKIPIKAIKTVGKAVGKGLRAINIASTANDVFNFLKPKKRKH

SEQ ID NO: 1003 - protein, 54 aa, Hyblaea puera; identical to SEQ ID NO: 1002

SEQ ID NO: 1004 - protein, 39 aa, Galleria mellonella
KVNVNAIKKGGKAIGKGFKVISAASTAHDVYEHIKNRRH

SEQ ID NO: 1005 - protein, 38 aa, Galleria mellonella
KVPIGAIKKGGKIIKKGLGVIGAAGTAHEVYSHVKNRH

SEQ ID NO: 1006 - protein, 38 aa, Galleria mellonella
KVPIGAIKKGGKIIKKGLGVLGAAGTAHEVYNHVRNRQ

SEQ ID NO: 1007 - protein, 38 aa, Galleria mellonella
KVPIGAIKKGGKIIKKGLGVIGAAGTAHEVYSHVKNRQ

SEQ ID NO: 1008 - protein, 38 aa, Galleria mellonella
KVPVGAIKKGGKAIKTGLGVVGAAGTAHEVYSHIRNRH

SEQ ID NO: 1009 - protein, 38 aa, Galleria mellonella; identical to SEQ ID NO: 1008

SEQ ID NO: 1010 - protein, 38 aa, Galleria mellonella
KGIGSALKKGGKIIKGGLGALGAIGTGQQVYEHVQNRQ

SEQ ID NO: 1011 - protein, 24 aa, Artificial Sequence
  Description of Artificial Sequence: Synthetic anti-microbial peptide
GIGKFLKKAKKGIGAVLKVLTTGL

SEQ ID NO: 1012 - protein, 22 aa, Artificial Sequence
  Description of Artificial Sequence: Synthetic anti-microbial peptide
GIGKFLKKAKKFGKAFVKILKK

SEQ ID NO: 1013 - protein, 28 aa, Ovis aries
RDSLQRGGQKILEKAERIGDRIKDIFRG

SEQ ID NO: 1014 - protein, 18 aa, Bos taurus
GRFKRFRKKFKKLFKKLS

SEQ ID NO: 1015 - protein, 18 aa, Bos taurus
GGLRSLGRKILRAWKKYG

SEQ ID NO: 1016 - protein, 26 aa, Equus caballus
KRFGRLAKSFLRMRILLPRRKILLAS

SEQ ID NO: 1017 - protein, 27 aa, Equus caballus
KRRHWFPLSFQEFLEQLRRFRDQLPFP

SEQ ID NO: 1018 - protein, 40 aa, Equus caballus
KRFHSVGSLIQRHQQMIRDKSEATRHGIRIITRPKLLLAS

SEQ ID NO: 1019 - protein, 40 aa, Mytilus galloprovincialis
HPHVCTSYYCSKFCGTAGCTRYGCRNLHRGKLCFCLHCSR

SEQ ID NO: 1020 - protein, 103 aa, Mytilus galloprovincialis
MKAAVILAIALVAILAVHEAEASCASRCKGHCRARRCGYYVSVLYRGRCYCKCLRCSSEHSMKFPENEGSSPSDMMPQMNENENTEFGQDMPTGETEQGETGI

SEQ ID NO: 1021 - protein, 34 aa, Mytilus edulis
SCASRCKGHCRARRCGYYVSVLYRGRCYCKCLRC

SEQ ID NO: 1022 - protein, 33 aa, Mytilus edulis
DCCRKPFRKHCWDCTAGTPYYGYSTRNIFGCTC

SEQ ID NO: 1023 - protein, 47 aa, Nicotiana tabacum; identical to SEQ ID NO: 182

SEQ ID NO: 1024 - protein, 113 aa, Streptomyces carzinostaticus
AAPTATVTPSSGLSDGTVVKVAGAGLQAGTAYDVGQCAWVDTGVLACNPADFSSVTADANGSASTSLTVRRSFEGFLFDGTRWGTVDCTTAACQVGLSDAAGNGPEGVAISFN

SEQ ID NO: 1025 - protein, 51 aa, Caenorhabditis elegans
QWGYGGPYGGYGGGYGGGPWGYGGGWRRRHWGGYGGGPWGGYGGGPWGGYY

SEQ ID NO: 1026 - protein, 34 aa, Oryctolagus cuniculus
GRCVCRKQLLCSYRERRIGDCKIRGVRFPFCCPR

SEQ ID NO: 1027 - protein, 33 aa, Oryctolagus cuniculus
VSCTCRRFSCGFGERASGSCTVNGVRHTLCCRR

SEQ ID NO: 1028 - protein, 33 aa, Oryctolagus cuniculus
VFCTCRGFLCGSGERASGSCTINGVRHTLCCRR

SEQ ID NO: 1029 - protein, 48 aa, Bubalus bubalis
LLLLLVVLSSGSGFTQGVGSNLTCWRNRGICQLKQGPVRMNQIGTCFG

SEQ ID NO: 1030 - protein, 49 aa, Bubalus bubalis
LLALLFLVLSAGSGFTQGVGNPVSCARNKGICVPSRCPGNMRQMICHDY

SEQ ID NO: 1031 - protein, 36 aa, Bubalus bubalis
LLALLFLVLSAGSGFTQGVGNPVSCARNKGICVPSR

SEQ ID NO: 1032 - protein, 40 aa, Bubalus bubalis
LLVLLFLVLSAGSGFTQGVGNPVAVLGIKASVCRAGALET

SEQ ID NO: 1033 - protein, 36 aa, Bubalus bubalis
SPLSCRGNRGVCLPIRCPGRLRQIGTCFGPRVPCCR

SEQ ID NO: 1034 - protein, 31 aa, Cavia porcellus
RRCICTTRTCRFPYRRLGTCIFQNRVYTFCC

SEQ ID NO: 1035 - protein, 31 aa, Cavia porcellus
RRCICTTRTCRFPYRRLGTCLFQNRVYTFCC

SEQ ID NO: 1036 - protein, 34 aa, Pan troglodytes
VCSCRLVFCRRTELRVGNCLIGGVSFTYCCTRVD

SEQ ID NO: 1037 - protein, 30 aa, Pan troglodytes
ACYCRIPACLAGERRYGTCIYQGRLWAFCC

SEQ ID NO: 1038 - protein, 104 aa, Rhipicephalus microplus
MKVLLAITLVAILGVASGTQFSLCQAPSERRHELVNCVKTHLNEQASQKLSEVKQRLNCEDLDCVFTKICELSSDTHQEHANTFLPDDVKTDVRAALTQCRPSN

SEQ ID NO: 1039 - protein, 21 aa, Rana nigrovittata
FTMKKSLFLLFFLGTISLSLC

SEQ ID NO: 1040 - protein, 25 aa, Rana nigrovittata
FTMKKSLLLIFFLGTISLSLCEQER

SEQ ID NO: 1041 - protein, 21 aa, Rana nigrovittata
FTMKKSPLLLFFLGTISLSLC

SEQ ID NO: 1042 - protein, 21 aa, Rana nigrovittata
FTMKKSLLFIFFLGTISLSLC

SEQ ID NO: 1043 - protein, 21 aa, Rana nigrovittata
FTMKKSLLLIFFLGTISLSLC

SEQ ID NO: 1044 - protein, 21 aa, Rana nigrovittata
FTMKKSLFLILFLGAIPLSMC

SEQ ID NO: 1045 - protein, 33 aa, Rana nigromaculata
GLLDSIKGMAISAGKGALQNLLKVASCKLDKTC

SEQ ID NO: 1046 - protein, 21 aa, Rana nigromaculata
GLLSKVLGVGKKVLCGVSGLC

SEQ ID NO: 1047 - protein, 21 aa, Rana livida
GLLSKVLGVGKKVLCGVSGLC

SEQ ID NO: 1048 - protein, 21 aa, Rana grahami
GLFGKILGVGKKVLCGLSGMC

SEQ ID NO: 1049 - protein, 21 aa, Rana grahami
GLLSGILGAGKHIVCGLSGLC

SEQ ID NO: 1050 - protein, 21 aa, Odorrana grahami
GLLSGILGAGKHIICGLSGLC

SEQ ID NO: 1051 - protein, 21 aa, Odorrana grahami
GLLSGILGAGKQKVCGLSGLC

SEQ ID NO: 1052 - protein, 28 aa, Odorrana grahami
GLLSGILGAGKNIVCGLSGLLKLESEII

SEQ ID NO: 1053 - protein, 21 aa, Odorrana grahami
GLLSGILGAGKHIVCGLSGLR

SEQ ID NO: 1054 - protein, 21 aa, Odorrana grahami
GLLSGILGAGKNIVCGLSGLC

SEQ ID NO: 1055 - protein, 21 aa, Odorrana grahami
GLLSGVLGVGKKVLCGLSGLC

SEQ ID NO: 1056 - protein, 138 aa, Lactococcus lactis
KRSFTEYTQVIETVSKNKVFLEQLLLANPKLYDVMQKYNAGLLKKKRVKKLFESIYKYYKRSYLRSTPFGLFSETSIGVFSKSSQYKLMGKTTKGIRLDTQWLIRLVHKMEVDFSKKLSFTRNNANYKFGDRVFQVYT

SEQ ID NO: 1057 - protein, 91 aa, Beta vulgaris
ITCGLVASKLAPCIGYLQGAPGPSAACCGGIKSLNSAAASPADRKTACTCLKSAATSIKGINYGKAASLPRQCGVSVPYAISPNTNCNAIH

SEQ ID NO: 1058 - protein, 21 aa, Vigna radiata
MTCGQVQGNLAQCIGFLQKGG

SEQ ID NO: 1059 - protein, 93 aa, Oryza sativa
  Japonica Group
AVSCGDVTSSIAPCLSYVMGRESSPSSSCCSGVRTLNGKASSSADRRTACSCLKNMASSFRNLNMGNAASIPSKCGVSVAFPISTSVDCSKIN

SEQ ID NO: 1060 - protein, 90 aa, Hordeum vulgare
AISCGQVSSALSPCISYARGNGAKPPAACCSGVKRLAGAAQSTADKQAACKCIKSAAGGLNAGKAAGIPSMCGVSVPYAISASVDCSKIR

SEQ ID NO: 1061 - protein, 90 aa, Hordeum vulgare
AITCGQVSSALGPCAAYAKGSGTSPSAGCCSGVKRLAGLARSTADKQATCRCLKSVAGAYNAGRAAGIPSRCGVSVPYTISASVDCSKIH

SEQ ID NO: 1062 - protein, 94 aa, Ovis aries
RRLRPRRPRLPRPRPRPRPRPRSLPLPRPKPRPIPRPLPLPRPRPKPIPRPLPLPRPRPRRIPRPLPLPRPRPRPIPRPLPLPQPQPSPIPRPL

SEQ ID NO: 1063 - protein, 43 aa, Ovis aries
RFRPPIRRPPIRPPFRPPFRPPVRPPIRPPFRPPFRPPIGPFP

SEQ ID NO: 1064 - protein, 60 aa, Ovis aries
RRLRPRRPRLPRPRPRPRPRPRSLPLPRPQPRRIPRPILLPWRPPRPIPRPQIQPIPRWL

SEQ ID NO: 1065 - protein, 33 aa, Odorrana grahami
GFLDTFKNLALNAAKSAGVSVLNSLSCKLFKTC

SEQ ID NO: 1066 - protein, 32 aa, Odorrana grahami
GLGGAKKNFIIAANKTAPQSVKKTFSCKLYNG

SEQ ID NO: 1067 - protein, 13 aa, Odorrana grahami
FMPILSCSRFKRC

SEQ ID NO: 1068 - protein, 28 aa, Odorrana grahami
ATAWDFGPHGLLPIRPIRIRPLCGKDKS

SEQ ID NO: 1069 - protein, 20 aa, Odorrana grahami
AALKGCWTKSIPPKPCFGKR

SEQ ID NO: 1070 - protein, 33 aa, Odorrana grahami
GVLGTVKNLLIGAGKSAAQSVLKTLSCKLFNDC

SEQ ID NO: 1071 - protein, 29 aa, Odorrana grahami
GFMDTAKNAAKNVAVTLLDNLKCKITKAC

SEQ ID NO: 1072 - protein, 29 aa, Rana grahami
GFMDTAKNAAKNVAVTLLDNLKCKITKAC

SEQ ID NO: 1073 - protein, 29 aa, Odorrana grahami
GFMDTAKNVAKNVAVTLLDNLKCKITKAC

SEQ ID NO: 1074 - protein, 29 aa, Rana grahami
GFMDTAKNVAKNVAVTLLDNLKCKITKAC

SEQ ID NO: 1075 - protein, 30 aa, Rana andersonii
RGFMDTAKNVAKNMAVTLLDNLKCKITKAC

SEQ ID NO: 1076 - protein, 21 aa, Odorrana grahami
GIFGKILGVGKKVLCGLSGVC

SEQ ID NO: 1077 - protein, 30 aa, Odorrana grahami
GFFTLIKAANKLINKTVNKEAGKGGLEIMA

SEQ ID NO: 1078 - protein, 20 aa, Odorrana grahami
GLFTLIKCAYQLIAPTVACN

SEQ ID NO: 1079 - protein, 19 aa, Odorrana grahami
GLFTFIKCAYKLRAPAVAC

SEQ ID NO: 1080 - protein, 39 aa, Odorrana grahami
GLFTLIKGAAKLIGKTVPKKQARLGMNLWLVKLPTNVKT

SEQ ID NO: 1081 - protein, 9 aa, Odorrana grahami
DEKGPKWKR

SEQ ID NO: 1082 - protein, 24 aa, Rana grahami
VIPFVASVAAEMMQHVYCAASKKC

SEQ ID NO: 1083 - protein, 24 aa, Odorrana grahami
VIPFVASVAAEMMQHVYCAASKKC

SEQ ID NO: 1084 - protein, 38 aa, Odorrana grahami
GLLSGILGAGKHIVCGLSGPCQSLNRKSSDVEYHLAKC

SEQ ID NO: 1085 - protein, 14 aa, Odorrana grahami
GFSPNLPGKGLRIS

SEQ ID NO: 1086 - protein, 14 aa, Odorrana grahami
FLPPSPWKETFRTS

SEQ ID NO: 1087 - protein, 14 aa, Odorrana grahami
TSRCYIGYRRKWCS

SEQ ID NO: 1088 - protein, 16 aa, Odorrana grahami
GCSRWIIGIHGQICRD

SEQ ID NO: 1089 - protein, 12 aa, Odorrana grahami
GLLSGTSVRGST

SEQ ID NO: 1090 - protein, 23 aa, Odorrana grahami
GLFGKSSVHGRKYYVDLAGCAKA

SEQ ID NO: 1091 - protein, 76 aa, Opistophthalmus carinatus
KWFNEKSIQNKIDEKIGKNFLGGMAKAVVHKLAKNEFMCVANVDMTKSCDTHCQKASGEKGYCHGTKCKCGVPLSY

SEQ ID NO: 1092 - protein, 76 aa, Opistophthalmus carinatus
KWLNEKSIQNKIDEKIGKNFLGGMAKAVVHKLAKNEFMCMANMDPTGSCETHCQKASGEKGYCHGTKCKCGVPLSY

SEQ ID NO: 1093 - protein, 76 aa, Opistophthalmus carinatus
KWLNEKSIQNKIDEKIGKNFLGGMAKAVVHKLAKNEFMCVANVDMTKSCDTHCQKASGEKGYCHGTKCKCGVPLSY

SEQ ID NO: 1094 - protein, 76 aa, Opistophthalmus carinatus
KWLNEKSIQNKIDEKIGKNFLGGMAKAVVHKLAKNEFMCVANIDMTKSCDTHCQKASGEKGYCHGTKCKCGVPLSY

SEQ ID NO: 1095 - protein, 44 aa, Opistophthalmus carinatus
GKVWDWIKSTAKKLWNSEPVKELKNTALNAAKNLVAEKIGATPS

SEQ ID NO: 1096 - protein, 44 aa, Opistophthalmus carinatus
GKVWDWIKSTAKKLWNSEPVKELKNTALNAAKNFVAEKIGATPS

SEQ ID NO: 1097 - protein, 45 aa, Opistophthalmus carinatus
GKVWDWIKSTAKKLWNSEPVKELKNTALNAAKNLVAEKIGATPSE

SEQ ID NO: 1098 - protein, 44 aa, Opistophthalmus carinatus
GKVWDWIKKTAKDVLNSDVAKQLKNKALNAAKNFVAEKIGATPS

SEQ ID NO: 1099 - protein, 225 aa, Solanum lycopersicum
ATFEVRNNCPYTVWAASTPIGGGRRLDRGQTWVINAPRGTKMARIWGRTNCNFDGDGRGSCQTGDCGGVLQCTGWGKPPNTLAEYALDQFSNLDFWDISLVDGFNIPMTFAPTNPSGGKCHAIHCTANINGECPGSLRVPGGCNNPCTTFGGQQYCCTQGPCGPTDLSRFFKQRCPDAYSYPQDDPTSTFTCPSGSTNYRVVFCPNGVTSPNFPLEMPSSDEEAK

SEQ ID NO: 1100 - protein, 41 aa, Struthio camelus
APGNKAECEREKGYCGFLKCSFPFVVSGKCSRFFFCCKNIW

SEQ ID NO: 1101 - protein, 135 aa, Solanum lycopersicum
QNSPQDYLAVHNDARAQVGVGPMSWDANLASRAQNYANSRAGDCNLIHSGAGENLAKGGGDFTGRAAVQLWVSERPSYNYATNQCVGGKKCRHYTQVVWRNSVRLGCGRARCNNGWWFISCNYDPVGNWIGQRPY

SEQ ID NO: 1102 - protein, 18 aa, Artificial Sequence
  Description of Artificial Sequence: Synthetic anti-microbial peptide
KWKLFKKIPKFLHLAKKF

SEQ ID NO: 1103 - protein, 27 aa, Odorrana versabilis
ALSILRGLEKLAKMGIALTNCKATKKC

SEQ ID NO: 1104 - protein, 48 aa, Odorrana versabilis
GIFPKIIGKGIKTGIVNGIKSLVKGVGMKVFKAGLSNIGNTGCNEDEC

SEQ ID NO: 1105 - protein, 31 aa, Odorrana grahami
GLWDTIKQAGKKFFLNVLDKIRCKVAGGCRT

SEQ ID NO: 1106 - protein, 25 aa, Rana andersonii
IGTISLSLCEQERDADEDEGETLEE

SEQ ID NO: 1107 - protein, 45 aa, Parabuthus schlechteri
FKLGSFLKKAWKSKLAKKLRAKGKEMLKDYAKGLLEGGSEEVPGQ

SEQ ID NO: 1108 - protein, 33 aa, Pardachirus marmoratus
GFFALIPKIISSPLFKTLLSAVGSALSSSGGQE

SEQ ID NO: 1109 - protein, 230 aa, Nicotiana tabacum
SGVFEVHNNCPYTVWAAATPVGGGRRLERGQSWWFWAPPGTKMARIWGRTNCNFDGAGRGWCQTGDCGGVLECKGWGKPPNTLAEYALNQFSNLDFWDISVIDGFNIPMSFGPTKPGPGKCHGIQCTANINGECPGSLRVPGGCNNPCTTFGGQQYCCTQGPCGPTELSRWFKQRCPDAYSYPQDDPTSTFTCTSWTTDYKVMFCPYGSAHNETTNFPLEMPTSTHEVAK

SEQ ID NO: 1110 - protein, 78 aa, Litopenaeus vannamei
MRLVVCLVFLASFALVCQGQVYKGGYTRPVPRPPFVRPLPGGPIGPYNGCPVSCRGISFSQARSCCSRLGRCCHVGKG

SEQ ID NO: 1111 - protein, 50 aa, Litopenaeus vannamei
YRGGYTGPIPRPPPIGRPPLRPVCNACYRLSVSDARNCCIKFGSCCHLVK

SEQ ID NO: 1112 - protein, 50 aa, Litopenaeus setiferus
QRGGFTGPIPRPPPHGRPPLGPICNACYRLSFSDVRICCNFLGKCCHLVK

SEQ ID NO: 1113 - protein, 62 aa, Litopenaeus vannamei
QVYKGGYTRPVPRPPPFVRPLPGGPIGPYNGCPVSCRGISFSQARSCCSRLGRCCHVGKGYS

SEQ ID NO: 1114 - protein, 61 aa, Litopenaeus vannamei
QVYKGGYTRPIPRPPFVRPVPGGPIGPYNGCPVSCRGISFSQARSCCSRLGRCCHVGKGYS

SEQ ID NO: 1115 - protein, 62 aa, Litopenaeus vannamei
QVYKGGYTRPIPRPPPFVRPLPGGPIGPYNGCPISCRGISFSQARSCCSRLGRCCHVGKGYS

SEQ ID NO: 1116 - protein, 62 aa, Litopenaeus vannamei
QVYKGGYTRPIPRPPPFVRPLPGGPISPYNGCPVSCRGISFSQARSCCSRLGRCCHVGKGYS

SEQ ID NO: 1117 - protein, 62 aa, Litopenaeus vannamei
QVYKGGYTRPIPRPPPFVRPLPGGPIGPYNGCPISCRGISFSQARSYCSRLGRCCHVGKGYS

SEQ ID NO: 1118 - protein, 62 aa, Litopenaeus vannamei
QVYKGGYTRPIPRPPPFVRPLPGGPIGPYNGRPVSCRGISFSQARSCCSRLGRCCHVGKGYS

SEQ ID NO: 1119 - protein, 61 aa, Litopenaeus vannamei
QVYKGGYTRPVPRPPFVRPLPGGPIGPYNGCPVSCRGISFSQARSCCSRLGRCCHVGKGYS

SEQ ID NO: 1120 - protein, 55 aa, Litopenaeus setiferus
QGYKGPYTRPILRPYVRPVVSYNACTLSCRGITTTQARSCCTRLGRCCHVAKGYS

SEQ ID NO: 1121 - protein, 55 aa, Litopenaeus setiferus
QGYKGPYTRPILRPYVRPVVSYNVCTLSCRGITTTQARSCCTRLGRCCHVAKGYS

SEQ ID NO: 1122 - protein, 55 aa, Litopenaeus setiferus
QGCKGPYTRPILRPYVRPVVSYNACTLSCRGITTTQARSCCTRLGRCCHVAKGYS

SEQ ID NO: 1123 - protein, 55 aa, Litopenaeus setiferus
QGYKGPYTRPILRPYVRPVVSYNACTLSCRGITTTQARSCSTRLGRCCHVAKGYS

SEQ ID NO: 1124 - protein, 47 aa, Litopenaeus vannamei
HSSGYTRPLPKPSRPIFIRPIGCDVCYGIPSSTARLCCFRYGDCCHR

SEQ ID NO: 1125 - protein, 47 aa, Litopenaeus vannamei
YSSGYTRPLPKPSRPIFIRPIGCDVCYGIPSSTARLCCFRYGDCCHR

SEQ ID NO: 1126 - protein, 18 aa, Mesobuthus martensii
FLSSLIPSAISGLISAFK

SEQ ID NO: 1127 - protein, 18 aa, Rana pipiens
LVRGCWTKSYPPKPCFVR

SEQ ID NO: 1128 - protein, 534 aa, Homo sapiens
PCHTAARSECKRSHKFVPGAWLAGEGVDVTSLRRSGSFPVDTQRFLRPDGTCTLCENALQEGTLQRLPLALTNWRAQGSGCQRHVTRAKVSSTEAVARDAARSIRNDWKVGLDVTPKPTSNVHVSVAGSHSQAANFAAQKTHQDQYSFSTDTVECRFYSFHVVHTPPLHPDFKRALGDLPHHFNASTQPAYLRLISNYGTHFIRAVELGGRISALTALRTCELALEGLTDNEVEDCLTVEAQVNIGIHGSISAEAKACEEKKKKHKMTASFHQTYRERHSEVVGGHHTSINDLLFGIQAGPEQYSAWVNSLPGSPGLVDYTLEPLHVLLDSQDPRREALRRALSQYLTDRARWRDCSRPCPPGRQKSPRDPCQCVCHGSAVTTQDCCPRQRGLAQLEVTFIQAWGLWGDWFTATDAYVKLFFGGQELRTSTVWDNNNPIWSVRLDFGDVLLATGGPLRLQVWDQDSGRDDDLLGTCDQAPKSGSHEVRCNLNHGHLKFRYHARCLPHLGGGTCLDYVPQMLLGEPPGNRSGAVW

SEQ ID NO: 1129 - protein, 534 aa, Mus musculus
PCYTATRSECKQKHKFVPGVWMAGEGMDVTTLRRSGSFPVNTQRFLRPDRTCTLCKNSLMRDATQRLPVAITHWRPHSSHCQRNVAAAKVHSTEGVAREAAANINNDWRVGLDVNPRPEANMRASVAGSHSKVANFAAEKTYQDQYNFNSDTVECRMYSFRLVQKPPLHLDFKKALRALPRNFNSSTEHAYHRLISSYGTHFITAVDLGGRISVLTALRTCQLTLNGLTADEVGDCLNVEAQVSIGAQASVSSEYKACEEKKKQHKMATSFHQTYRERHVEVLGGPLDSTHDLLFGNQATPEQFSTWTASLPSNPGLVDYSLEPLHTLLEEQNPKREALRQAISHYIMSRARWQNCSRPCRSGQHKSSHDSCQCECQDSKVTNQDCCPRQRGLAHLVVSNFRAEHLWGDYTTATDAYLKVFFGGQEFRTGVVWNNNNPRWTDKMDFENVLLSTGGPLRVQVWDADYGWDDDLLGSCDRSPHSGFHEVTCELNHGRVKFSYHAKCLPHLTGGTCLEYAPQGLLGDPPGNRSGAVW

SEQ ID NO: 1130 - protein, 534 aa, Rattus norvegicus
PCYTATRSECKQNHKFVPGVWAAGEGVDVTTLRRSSSFPVNTGKFLRPDRTCTLCKNALMNDGIQRLPVAIAHWRPHGSHCQRNVATTKVSSTEGVAREAAANINNDWRAGLDVNPKPEANVHVSVAGSHSKIANFAAEKAHQDQYNFNTDTVECRMYSFRLAQKPPLHPDFRKALKNLPHNFNSSTEHAYRRLISSYGTHFITAVDLGGRVSVLTALRTCQLTLDGLTADEVGDCLSVEAQVSIGAQASVSSEYKACEEKKKQHKIATSFHQTYRERHVEVLGGPLDSSNDLLFGNQATPEHFSTWIASLPTRPDVVDYSLEPLHILLEDSDPKREALRQAISHYVMSRARWRDCNRPCRAGQHKSSRDSCQCVCQDSNVTNQDCCPRQRGLAKLMVRNFQAKGLWGDYITSTDAYLKVFFGGQEIRTGVVWNNNHPSWSDKMDFGNVLLSTGGPLRVQVWDADNGWDDDLLGTCDKSPKSGFHEVNCPLNHGSIKFIYQANCLPDLTGETCLEYAPQGLLGDPRGNRSGAVW

SEQ ID NO: 1131 - protein, 51 aa, Perinereis aibuhitensis
FNKLKQGSSKRTCAKCFRKIMPSVHELDERRRGANRWAAGFRKCVSSICRY

SEQ ID NO: 1132 - protein, 19 aa, Phyllomedusa azurea
FLSLIPHAINAVGVHAKHF

SEQ ID NO: 1133 - protein, 19 aa, Phyllomedusa azurea
FLSLIPAAISAVSALADHF

SEQ ID NO: 1134 - protein, 20 aa, Phyllomedusa azurea
LLSLVPHAINAVSAIAKHFG

SEQ ID NO: 1135 - protein, 19 aa, Artificial Sequence
  Description of Artificial Sequence: Synthetic anti-microbial peptide
FLSLIPHAINAVSTLVHHF

SEQ ID NO: 1136 - protein, 19 aa, Artificial Sequence
  Description of Artificial Sequence: Synthetic anti-microbial peptide
FLSLIPHAINAVSALANHG

SEQ ID NO: 1137 - protein, 19 aa, Phyllomedusa hypochondrialis
FLSLIPHAINAVSALANHG

SEQ ID NO: 1138 - protein, 20 aa, Phyllomedusa oreades
FLSLIPHAINAVSTLVHHSG

SEQ ID NO: 1139 - protein, 19 aa, Phyllomedusa oreades
FLSLIPHAINAVSAIAKHS

SEQ ID NO: 1140 - protein, 17 aa, Phyllomedusa hypochondrialis
SLIPHAINAVSAIAKHF

SEQ ID NO: 1141 - protein, 19 aa, Phyllomedusa tomopterna
FLSLIPHAINAVSALAKHF

SEQ ID NO: 1142 - protein, 20 aa, Myrmecia pilosula
GLGSVFGRLARILGRVIPKV

SEQ ID NO: 1143 - protein, 20 aa, Myrmecia pilosula
GLLSKFGRLARKLARVIPKV

SEQ ID NO: 1144 - protein, 46 aa, Vigna radiata
RTCMIKKEGWGKCLIDTTCAHSCKNRGYIGGNCKGMTRTCYCLVNC

SEQ ID NO: 1145 - protein, 66 aa, Homo sapiens
AELRCMCIKTTSGIHPKNIQSLEVIGKGTHCNQVEVIATLKDGRKICLDPDAPRIKKIVQKKLAGD

SEQ ID NO: 1146 - protein, 118 aa, Pacifastacus leniusculus
MRVCVMVLALVVVTMARSPPFRPLSCPRPKVDIPGCVNTCQAKDKPGFFYCCDSKGLNAGTCPKVHLQPYERNVLCDRTQFNYPNHLNCKDDEDCQVFEKCCYLPDNHQLICRNSEDI

SEQ ID NO: 1147 - protein, 109 aa, Pacifastacus leniusculus
MLRVLMMSLLVVAALGHISPPRPEGCNYYCKKPEGPNKGSNYCCGPEYIPLKREEKHAGNCPPPLKECTRFPRPPQVCPHDGHCPYNQKCCFDTCLDIHTCKPAHFYIN

SEQ ID NO: 1148 - protein, 157 aa, Pacifastacus leniusculus
MKCLQSVLVLVLLLAMVSAQNTNTTNTRIGGFAGGSGLLPGPAIGGGIGIPGGVLLPGSFQGGISGGIIHQYGLDCSGNSLSPQTGNCRYYLRNPVNRRYYCTRNQKPAYKCPLLRPDCPDTRSGPPVECYTDNDCGPLDKCCCDACLDHYVCKPAA

SEQ ID NO: 1149 - protein, 26 aa, Rana pleuraden
SIITMTKEAKLPQLWKQIACRLYNTC

SEQ ID NO: 1150 - protein, 26 aa, Rana pleuraden
SIITMTKEAKLPQSWKQIACRLYNTC

SEQ ID NO: 1151 - protein, 26 aa, Rana pleuraden
SIITMTREAKLPQLWKQIACRLYNTC

SEQ ID NO: 1152 - protein, 26 aa, Rana pleuraden
SIITTTKEAKLPQLWKQIACRLYNTC

SEQ ID NO: 1153 - protein, 8 aa, Pleurotus ostreatus
VRPYLVAF

SEQ ID NO: 1154 - protein, 37 aa, Unknown
  Description of Unknown: Cercopithecidae peptide
RLGNFFRKAKKKIGRGLKKIGQKIKDFLGNLVPRTES

SEQ ID NO: 1155 - protein, 18 aa, Limulus polyphemus
RRWCFRVCYRGFCYRKCR

SEQ ID NO: 1156 - protein, 18 aa, Limulus polyphemus
RRWCFRVCYKGFCYRKCR

SEQ ID NO: 1157 - protein, 87 aa, Mus musculus
NWVKQAPGKGLKWMGWIRTNTGEPTYVDDFKGRFAFSLETSASTAFLQINNLKNEDTATYFCAITTATSDYYAMDYWGQGTSVTVSS

SEQ ID NO: 1158 - protein, 30 aa, Pachycondyla goeldii
GWKDWAKKAGGWLKKKGPGMAKAALKAAMQ

SEQ ID NO: 1159 - protein, 30 aa, Pachycondyla goeldii
GWKDWLKKGKEWLKAKGPGIVKAALQAATQ

SEQ ID NO: 1160 - protein, 30 aa, Pachycondyla goeldii
GWKDWLNKGKEWLKKKGPGIMKAALKAATQ

SEQ ID NO: 1161 - protein, 29 aa, Pachycondyla goeldii
DFKDWMKTAGEWLKKKGPGILKAAMAAAT

SEQ ID NO: 1162 - protein, 18 aa, Pachycondyla goeldii
GLVDVLGKVGGLIKKLLP

SEQ ID NO: 1163 - protein, 19 aa, Pachycondyla goeldii
GLVDVLGKVGGLIKKLLPG

SEQ ID NO: 1164 - protein, 25 aa, Pachycondyla goeldii
WLGSALKIGAKLLPSVVGLFKKKKQ

SEQ ID NO: 1165 - protein, 25 aa, Pachycondyla goeldii
WLGSALKIGAKLLPSVVGLFQKKKK

SEQ ID NO: 1166 - protein, 26 aa, Pachycondyla goeldii
GIWGTLAKIGIKAVPRVISMLKKKKQ

SEQ ID NO: 1167 - protein, 26 aa, Pachycondyla goeldii
GIWGTALKWGVKLLPKLVGMAQTKKQ

SEQ ID NO: 1168 - protein, 24 aa, Pachycondyla goeldii
FWGALIKGAAKLIPSVVGLFKKKQ

SEQ ID NO: 1169 - protein, 36 aa, Macaca mulatta; identical to SEQ ID NO: 442

SEQ ID NO: 1170 - protein, 32 aa, Homo sapiens
VDCRRSEGFCQEYCNYMETQVGYCSKKKDACC

SEQ ID NO: 1171 - protein, 23 aa, Rana sakuraii
VIGSILGALASGLPTLISWIKNR

SEQ ID NO: 1172 - protein, 23 aa, Rana tagoi
AIGSILGALAKGLPTLISWIKNR

SEQ ID NO: 1173 - protein, 19 aa, Rana sakuraii
FLPVILPVIGKLLNGILGK

SEQ ID NO: 1174 - protein, 51 aa, Arabidopsis thaliana
QKLCEKPSGTWSGVCGNSNACKNQCINLEGAKHGSCNYVFPAHKCICYFPC

SEQ ID NO: 1175 - protein, 67 aa, Bubalus bubalis
ALSYREAVLRAVDRINDGSSEANLYRLLELDPPPKDVEDRGARKPASFRVKETVCPRTSQQPLEQCD

SEQ ID NO: 1176 - protein, 37 aa, Galleria mellonella
DIQIPGIKKPTHRDIIIPNWNPNVRTQPWQRFGGNKS

SEQ ID NO: 1177 - protein, 202 aa, Galleria mellonella
MLKLTYVLGVLLVLFIVDSSCQRIILPTYRPPRQRPVIIRTVREADEPLWLYKGDNIERAPTTADHPILPSIIDDVKLDPNRRYARSLDSPSAKRGGGSHSTSSGSHDAGATHPGYNRRNAREIRLPEPFRFPSPTVPKPIDIDPILPHPWSPRQTYPIYARSTRDIQIPGIKKPTHRDIIIPNWNPNVRTQPWQRFGGNKS

SEQ ID NO: 1178 - protein, 79 aa, Sus scrofa
AFPPPNVPGPRFPPPNVPGPRFPPPNFPGPRFPPPNFPGPRFPPPNFPGPPFPPPIFPGPWFPPPPPFRPPPFGPPRFP

SEQ ID NO: 1179 - protein, 18 aa, Sus scrofa
RGGRLCYCRGWICFCVGR

SEQ ID NO: 1180 - protein, 18 aa, Sus scrofa
RGGRLCYCRPRFCVCVGR

SEQ ID NO: 1181 - protein, 208 aa, Nicotiana tabacum
SGVFEVHNNCPYTVWAAATPVGGGRRLERGQSWWFWAPPGTKMARIWGRTNCNFDGAGRGWCQTGDCGGVLECKGWGKPPNTLAEYALNQFSNLDFWDISVIDGFNIPMSFGPTKPGPGKCHGIQCTANINGECPGSLRVPGGCNNPCTTFGGQQYCCTQGPCGPTELSRWFKQRCPDAYSYPQDDPTSTFTCTSWTTDYKVMFCPYG

SEQ ID NO: 1182 - protein, 226 aa, Solanum lycopersicum
ATIEVRNNCPYTVWAASTPIGGGRRLNRGQTWVINAPRGTKMARIWGRTGCNFNAAGRGTCQTGDCGGVLQCTGWGKPPNTLAEYALDQFSNLDFWDISLVDGFNIPMTFAPTKPSGGKCHAIHCTANINGECPRALKVPGGCNNPCTTFGGQQYCCTQGPCGPTELSKFFKKRCPDAYSYPQDDPTSTFTCPGGSTNYRVVFCPNGVADPNFPLEMPASTDEVAK

SEQ ID NO: 1183 - protein, 280 aa, Hordeum vulgare
AAKMAKNVDKPLFTATFNVQASSADYATFIAGIRNKLRNPAHFSHNRPVLPPVEPNVPPSRWFHVVLKASPTSAGLTLAIRADNIYLEGFKSSDGTWWELTPGLIPGATYVGFGGTYRDLLGDTDKLTNVALGRQQLADAVTALHGRTKADKPSGPKQQQAREAVTTLLLMVNEATRFQTVSGFVAGLLHPKAVEKKSGKIGNEMKAQVNGWQDLSAALLKTDVKPPPGKSPAKFAPIEKMGVRTAVQAANTLGILLFVEVPGGLTVAKALELFHASGGK

SEQ ID NO: 1184 - protein, 280 aa, Hordeum vulgare
AAKMAKNVDKPLFTATFNVQASSADYATFIAGIRNKLRNPAHFSHNEPVLPPVEPNVPPSRWFHVVLKASPTSAGLTLAIRADNIYLEGFKSSDGTWWELTPGLIPGATYVGFGGTYRDLLGDTDKLTNVALGRQQLEDAVTALHGRTKADKASGPKQQQAREAVTTLLLMVNEATRFQTVSGFVAGLLHPKAVEKKSGKIGNEMKAQVNGWQDLSAALLKTDVKPPPGKSPAKFTPIEKMGVRTAEQAAATLGILLFVEVPGGLTVAKALELFHASGGK

SEQ ID NO: 1185 - protein, 33 aa, Psalmopoeus cambridge
ACGILHDNCVYVPAQNPCCRGLQCRYGKCLVQV

SEQ ID NO: 1186 - protein, 28 aa, Psalmopoeus cambridge
RCLPAGKTCVRGPMRVPCCGSCSQNKCT

SEQ ID NO: 1187 - protein, 24 aa, Pseudis paradoxa
GLNTLKKVFQGLHEAIKLINNHVQ

SEQ ID NO: 1188 - protein, 24 aa, Pseudis paradoxa
GLNALKKVFQGIHEAIKLINNHVQ

SEQ ID NO: 1189 - protein, 23 aa, Pseudis paradoxa
GINTLKKVIQGLHEVIKLVSNHE

SEQ ID NO: 1190 - protein, 23 aa, Pseudis paradoxa
GINTLKKVIQGLHEVIKLVSNHA

SEQ ID NO: 1191 - protein, 45 aa, Hevea brasiliensis
EQCGRQAGGKLCPNNLCCSQYGWCGSSDDYCSPSKNCQSNCKGGG

SEQ ID NO: 1192 - protein, 101 aa, Equus caballus
MSETEAEASVIGIIELFHKYTGRDDMIDKPGLLKMLQDNFPNFLAACDKKGTDYLANVFEKKDKNRDKKIDFSEFLSLLGDIATDYHKQSHGAPACSEGDQ

SEQ ID NO: 1193 - protein, 45 aa, Oiketicus kirbyi
INNWVRVPPCDQVCSRTNPEKDECCRAHGHAFHATCSGGMQCYRR

SEQ ID NO: 1194 - protein, 119 aa, Triticum aestivum
EVGGGGGSQQCPQERPKLSSCKDYVMERCFTMKDFPVTWPTKWWKGGCEHEVREKCCKQLSQIAPQCRCDSIRRVIQGRLGGFLGIWRGEVFKQLQRAQSLPSKCNMGADCKFPSGYYW

SEQ ID NO: 1195 - protein, 50 aa, Arabidopsis thaliana
LCKRESETWSGRCVNDYQCRDHCINNDRGNDGYCAGGYPWYRSCFCFFSC

SEQ ID NO: 1196 - protein, 43 aa, Opisthacanthus cayaporum
GFWSKIKDFAKKAWNSPLANELKSKALNAAKNFVSEKIGATPS

SEQ ID NO: 1197 - protein, 37 aa, Ciona intestinalis
AALRGALRAVARVGKAILPHVAIANPYVRTPYVHNNP

SEQ ID NO: 1198 - protein, 15 aa, Artificial Sequence
  Description of Artificial Sequence: Synthetic anti-microbial peptide
MEYWCYRKKPYRKCR

SEQ ID NO: 1199 - protein, 260 aa, Nocardia farcinica
  IFM 10152
MNNLHRELAPITSEAWAAIEEEAGRTFKRHIAGRRVVDVAGPHGVDFSAVGLGRTTGIAAPDEGVQARQRVVAPLVELRVPFTLSREELDNVERGAKDTDLDAVKEAARRIAFAEDRAIFEGYPAAGITGIRAAGSNAPITVPDDARLVPEAITQALTALRLAGVDGPYSVLLSAELYTEVSETSDHGYPIRTHIERLIPDGEIIWAPAIDGAFVLTTRGGDYELTLGQDVSIGYLSHDADTVRLYFQQTMQFLVHTAEA

SEQ ID NO: 1200 - protein, 221 aa, Salmonella enterica
  subsp. enterica serovar Schwa
HPDIVDYFMKRHNWHFKFFHYEEDDKIKGAYFICNDQNIGILTRRTFPLSSDEILIPMAPDLRCFLPDRTNRLSALHQPQIRNAIWKLTRKKQNCLVKEAFSSKFEKTRRNEYQRFLKKGGSVKSVADCSSDELTHIFIELFRSRFGNTSSCYPADNLANFFSQLHHLLFGHILYIEGIPCAFDIVLKSESQMNVYFDVSNGAIKNECRPLSPGSILMWLN

SEQ ID NO: 1201 - protein, 221 aa, Salmonella enterica
  subsp. enterica serovar Kentu
HPDIVDYFMKRHNWHFKFFHYKEDDKIKGAYFICNDQNIGILTRRTFPLSSDEILIPMAPDLRCFLPDRTNRLSALHQPQIRNAIWKLTRKKQNCLVKETFSSKFEKRRRNEYQQFLKKGGSVKSVADCSSDELTHIFIELFQSRFGNTLSCYPADNLATFFSQLHHLLFGHILYIEGIPCAFDIVLKSESQMNVYFDVSNGAIKNEFRPLSPGSILMWLN

SEQ ID NO: 1202 - protein, 12 aa, Unknown
  Description of Unknown: Anti-microbial peptide
HPLKQYWWRPSI

SEQ ID NO: 1203 - protein, 21 aa, Xenopus laevis
GMASKAGAIAGKIAKVALKAL

SEQ ID NO: 1204 - protein, 17 aa, Rana esculenta
SAPRGCWTKSYPPKPCK

SEQ ID NO: 1205 - protein, 17 aa, Rana temporaria
GALRGCWTKSYPPKPCK

SEQ ID NO: 1206 - protein, 20 aa, Rana catesbeiana
FLGGLIKIVPAMICAVTKKC

SEQ ID NO: 1207 - protein, 20 aa, Rana clamitans
FLGGLMKAFPALICAVTKKC

SEQ ID NO: 1208 - protein, 20 aa, Rana clamitans
FLGGLMKAFPAIICAVTKKC

SEQ ID NO: 1209 - protein, 28 aa, Rana sakuraii
GLLDAIKDTAQNLFANVLDKIKCKFTKC

SEQ ID NO: 1210 - protein, 25 aa, Rana catesbeiana
SMLSVLKNLGKVGLGFVACKINKQC

SEQ ID NO: 1211 - protein, 25 aa, Rana clamitans
SMLSVLKNLGKVGLGLVACKINKQC

SEQ ID NO: 1212 - protein, 37 aa, Rana catesbeiana
FPLKKSLLLLFFFGTIPLSFCEQERGADEEEGNGEKE

SEQ ID NO: 1213 - protein, 37 aa, Rana catesbeiana
FTMKKSLLPLFFLGTITLSLCEQERGADEEEGNGEKE

SEQ ID NO: 1214 - protein, 33 aa, Rana amurensis
GLLSVFKGVLKGVGKNVAGSLLDQLKCKISGGC

SEQ ID NO: 1215 - protein, 33 aa, Rana amurensis
GLFSVVKGVLKGVGKNVAGSLLDQLKCKISGGC

SEQ ID NO: 1216 - protein, 28 aa, Rana berlandieri
GLLDTIKGVAKTVAASMLDKLKCKISGC

SEQ ID NO: 1217 - protein, 44 aa, Rana catesbeiana
FTVKKSLLLLFFLGTITLSFCEQERGADEDNGGEMTEEEVKRGV

SEQ ID NO: 1218 - protein, 31 aa, Rana clamitans
GLFLDTLKGAAKDVAGKLLEGLKCKIAGCKP

SEQ ID NO: 1219 - protein, 27 aa, Rana clamitans
GLFLDTLKGLAGKLLQGLKCIKAGCKP

SEQ ID NO: 1220 - protein, 32 aa, Rana luteiventris
GILDSFKGVAKGVAKDLAGKLLDKLKCKITGC

SEQ ID NO: 1221 - protein, 32 aa, Rana luteiventris
GILSSIKGVAKGVAKNVAAQLLDTLKCKITGC

SEQ ID NO: 1222 - protein, 17 aa, Rana ridibunda
AVNIPFKVKFRCKAAFC

SEQ ID NO: 1223 - protein, 17 aa, Rana ridibunda
AAKLLLNPKFRCKAAFC

SEQ ID NO: 1224 - protein, 28 aa, Rana versabilis
GLLDTIKNTAKNLAVGLLDKIKCKMTGC

SEQ ID NO: 1225 - protein, 28 aa, Rana versabilis
GIMDTVKGVAKTVAASLLDKLKCKITGC

SEQ ID NO: 1226 - protein, 51 aa, Raphanus sativus; identical to SEQ ID NO: 606
  var. niger

SEQ ID NO: 1227 - protein, 36 aa, Raphanus sativus
  var. niger
QKLCQRPSGTWSGVCGNNNACKNQCIRLEKARHGSC

SEQ ID NO: 1228 - protein, 14 aa, Luffa aegyptiaca
PRGSPRTEYEAARR

SEQ ID NO: 1229 - protein, 32 aa, Rana nigrovittata
FLSKFKDIALDVAKNAGKGVLTTLACKIDGSC

SEQ ID NO: 1230 - protein, 27 aa, Rana nigrovittata
FTMKKSLLFLFFLGTISLSFCEEERSA

SEQ ID NO: 1231 - protein, 33 aa, Rana nigrovittata
SFLSKFKDIALDVAKNAGKGVLTTLACKIDGSC

SEQ ID NO: 1232 - protein, 64 aa, Artificial Sequence
  Description of Artificial Sequence: Synthetic anti-microbial polypeptide
MRMSIKCFAVIFVAFAFFLGQISRAEACIPDGGRCHESDPGPGCCSGFCYRERNWKDGDCRKRP

SEQ ID NO: 1233 - protein, 36 aa, Oryctes rhinoceros
ELPKLPDDKVLIRSRSNCPKGKVWNGFDCKSPFAFS

SEQ ID NO: 1234 - protein, 48 aa, Bos taurus
SDEKASPDKHHRFSLSRYAKLANRLANPKLLETFLSKWIGDRGNRSVK

SEQ ID NO: 1235 - protein, 24 aa, Unknown
  Description of Unknown: Anti-microbial peptide
GIGKFLHSAKKFGKAFVGEIMNSK

SEQ ID NO: 1236 - protein, 32 aa, Unknown
  Description of Unknown: Anti-microbial peptide
KKIEKAIKHIPKKIKAGPGVTIGIAHAKSQLW

SEQ ID NO: 1237 - protein, 37 aa, Unknown
  Description of Unknown: Anti-microbial peptide
  MOD_RES (7)..(7): Any amino acid
  MOD_RES (32)..(32): Any amino acid
GFFKKAXRKVKHAGRRVLDTAKGVGRHYVNNXLNRYR

SEQ ID NO: 1238 - protein, 5 aa, Unknown
  Description of Unknown: Anti-microbial peptide
IIGGR

SEQ ID NO: 1239 - protein, 18 aa, Unknown
  Description of Unknown: Anti-microbial peptide
MASRAAGLAARLARLALR

SEQ ID NO: 1240 - protein, 34 aa, Unknown
  Description of Unknown: Anti-microbial peptide
RSGRGECRRQCLRRHEGQPWETQECMRRCRRRGG

SEQ ID NO: 1241 - protein, 25 aa, Unknown
  Description of Unknown: Anti-microbial peptide
RSVCRQIKICRRRGGCYYLCTNRPY

SEQ ID NO: 1242 - protein, 38 aa, Unknown
  Description of Unknown: Anti-microbial peptide
DFASCHTNGGICLPNRCPGHMIQIGICFRPRVLCCRSW

SEQ ID NO: 1243 - protein, 43 aa, Unknown
  Description of Unknown: Anti-microbial peptide
  MOD_RES (40)..(41): Any amino acid
RTCENLADKYRGPCFSGCDTHCTTKENAVSGRCRDDFRCXXTK

SEQ ID NO: 1244 - protein, 15 aa, Unknown
  Description of Unknown: Anti-microbial peptide
LTCDLLSFEAKGFAA

SEQ ID NO: 1245 - protein, 18 aa, Unknown
  Description of Unknown: Anti-microbial peptide
  MOD_RES (6)..(7): Any amino acid
  MOD_RES (10)..(11): Any amino acid
KNLRRXXRKXXHIIKKYG

SEQ ID NO: 1246 - protein, 15 aa, Unknown
  Description of Unknown: Anti-microbial peptide
CKNQCIRLEKARHGS

SEQ ID NO: 1247 - protein, 19 aa, Unknown
  Description of Unknown: Anti-microbial peptide
GRLRKKWKAFKKFLKILAC

SEQ ID NO: 1248 - protein, 49 aa, Unknown
  Description of Unknown: Anti-microbial peptide
  MOD_RES (10)..(10): Any amino acid
  MOD_RES (44)..(46): Any amino acid
RLCERPSGTXSGVCGNNNACRNQCRNLERAEHGSCNYVFPAHKXXXYFP

SEQ ID NO: 1249 - protein, 64 aa, Unknown
  Description of Unknown: Anti-microbial peptide
MRLHHLLLALLFLVLSAGSGFTQGVRNSQSCRRNKGICVPIRCPGSMRQIGTCLGAQVKCCRRK

SEQ ID NO: 1250 - protein, 11 aa, Unknown
  Description of Unknown: Anti-microbial peptide
  MOD_RES (2)..(3): Any amino acid
  MOD_RES (6)..(6): Any amino acid
  MOD_RES (8)..(8): Any amino acid
YXXIQXWXHYR

SEQ ID NO: 1251 - protein, 25 aa, Unknown
  Description of Unknown: Anti-microbial peptide
NQGRHFCGGALIHARFVMTAASCFQ

SEQ ID NO: 1252 - protein, 20 aa, Unknown
  Description of Unknown: Anti-microbial peptide
  MOD_RES (1)..(1): Any amino acid
  MOD_RES (4)..(10): Any amino acid
  MOD_RES (13)..(13): Any amino acid
  MOD_RES (15)..(15): Any amino acid
  MOD_RES (17)..(20): Any amino acid
XEDXXXXXXXRGXGXGXXXX

SEQ ID NO: 1253 - protein, 74 aa, Unknown
  Description of Unknown: Anti-microbial peptide
SDDPKESEGDLHCVCVKTTSLVRPRHITNLELIKAGGHCPTANLIATKKNGRKLCLDLQAALYKKKIIKKLLES

SEQ ID NO: 1254 - protein, 17 aa, Unknown
  Description of Unknown: Anti-microbial peptide
WCFAVCRRGRCRYKCRR

SEQ ID NO: 1255 - protein, 22 aa, Unknown
  Description of Unknown: Anti-microbial peptide
FIHHIFRGIVHAGRSIGRFLTG

SEQ ID NO: 1256 - protein, 51 aa, Unknown
  Description of Unknown: Anti-microbial peptide
EGRERDHELRHRRHHHQSPKSHFELPHYPGLLAHQKPFIRKSYKCLHKRCR

SEQ ID NO: 1257 - protein, 38 aa, Unknown
  Description of Unknown: Anti-microbial peptide
RRRPRPPYLPRPRPPPFFPPRLPPRIPPFPPRFPPRFP

SEQ ID NO: 1258 - protein, 85 aa, Unknown
  Description of Unknown: Anti-microbial peptide
NLAKGKEESLDSDLYAELRCMCIKTTSGIHPKNIQSLEVIGKGTHCNQVEVIATLKDGRKICLDPDAPRIKKIVQKKLAGDESAD

SEQ ID NO: 1259 - protein, 59 aa, Unknown [sequence omitted]

SEQ ID NO: 1260 - protein, 28 aa, Unknown
  Description of Unknown: Anti-microbial peptide
RVIRVVQRACRAIRHIVRRIRQGLRRIL

SEQ ID NO: 1261 - protein, 26 aa, Unknown
  Description of Unknown: Anti-microbial peptide
KWKSFIKKLTTAVKKVLTTGLPALIS

SEQ ID NO: 1262 - protein, 26 aa, Unknown
  Description of Unknown: Anti-microbial peptide
GIGAVLKVLTTGLPALISWIKRKRQQ

SEQ ID NO: 1263 - protein, 17 aa, Unknown
  Description of Unknown: Anti-microbial peptide
GSSKSPSKKKKKKPGDC

SEQ ID NO: 1264 - protein, 16 aa, Unknown
  Description of Unknown: Anti-microbial peptide
KFAKKFAKKFAKKFAK

SEQ ID NO: 1265 - protein, 13 aa, Unknown
  Description of Unknown: Anti-microbial peptide
DYQAKLAAYQKEL

SEQ ID NO: 1266 - protein, 7 aa, Unknown
  Description of Unknown: Anti-microbial peptide
MEHFRWG

SEQ ID NO: 1267 - protein, 18 aa, Unknown
  Description of Unknown: Anti-microbial peptide
GICRCICGRGICRCICGR

SEQ ID NO: 1268 - protein, 23 aa, Unknown
  Description of Unknown: Anti-microbial peptide
SNMIEGVFAKGFKKASHLFKGIG

SEQ ID NO: 1269 - protein, 28 aa, Unknown
  Description of Unknown: Anti-microbial peptide
KKIEKAIKHIPKKIKLKKALRALARHWK

SEQ ID NO: 1270 - protein, 7 aa, Unknown
  Description of Unknown: Anti-microbial peptide
HPQYNAR

SEQ ID NO: 1271 - protein, 20 aa, Unknown
  Description of Unknown: Anti-microbial peptide
MASRAAGLARRLARLARRAL

SEQ ID NO: 1272 - protein, 10 aa, Unknown
  Description of Unknown: Anti-microbial peptide
ILPWKWPWRR

SEQ ID NO: 1273 - protein, 40 aa, Unknown; identical to SEQ ID NO: 18
  Description of Unknown: Anti-microbial peptide

SEQ ID NO: 1274 - protein, 18 aa, Unknown
  Description of Unknown: Anti-microbial peptide
KNLRRIGRKIIHIIKKYG

SEQ ID NO: 1275 - protein, 36 aa, Unknown; identical to SEQ ID NO: 442
  Description of Unknown: Anti-microbial peptide

SEQ ID NO: 1276 - protein, 9 aa, Unknown
  Description of Unknown: Anti-microbial peptide
CIRLEKARH

SEQ ID NO: 1277 - protein, 14 aa, Unknown
  Description of Unknown: Anti-microbial peptide
KRLFKELFFSLRKY

SEQ ID NO: 1278 - protein, 25 aa, Unknown
  Description of Unknown: Anti-microbial peptide
NQGRHFCGGALIHARFVMTAARCFQ

SEQ ID NO: 1279 - protein, 13 aa, Unknown
  Description of Unknown: Anti-microbial peptide
NEPSINFYKRRGA

SEQ ID NO: 1280 - protein, 18 aa, Unknown
  Description of Unknown: Anti-microbial peptide
KLYKKWKNKLKRSLKRLG

SEQ ID NO: 1281 - protein, 18 aa, Unknown
  Description of Unknown: Anti-microbial peptide
RRWCRRVCYAGFCYRKCR

SEQ ID NO: 1282 - protein, 8 aa, Unknown
  Description of Unknown: Anti-microbial peptide
LAHQKPFI

SEQ ID NO: 1283 - protein, 25 aa, Unknown
  Description of Unknown: Anti-microbial peptide
KWKSFIKKLTSAAKKVTTAAKPLTK

SEQ ID NO: 1284 - protein, 13 aa, Unknown
  Description of Unknown: Anti-microbial peptide
ILKKYPYYPYRRK

SEQ ID NO: 1285 - protein, 24 aa, Unknown
  Description of Unknown: Anti-microbial peptide
RRWVRRVRRVWRRVVRVVRRWVRR

SEQ ID NO: 1286 - protein, 26 aa, Unknown
  Description of Unknown: Anti-microbial peptide
KWKSFIKNLTKVLKKVVTTALPALIS

SEQ ID NO: 1287 - protein, 28 aa, Unknown
  Description of Unknown: Anti-microbial peptide
RFARRFARRFARRFARRFARRFARRFAR

SEQ ID NO: 1288 - protein, 8 aa, Unknown
  Description of Unknown: Anti-microbial peptide
  MOD_RES (5)..(5): Any amino acid
VPKCXKPV

SEQ ID NO: 1289 - protein, 18 aa, Unknown
  Description of Unknown: Anti-microbial peptide
RGCICRCIGRGCICRCIG

SEQ ID NO: 1290 - protein, 16 aa, Unknown
  Description of Unknown: Anti-microbial peptide
LRRGGRWILAIPRAIL

SEQ ID NO: 1291 - protein, 16 aa, Unknown
  Description of Unknown: Anti-microbial peptide
GSCNYVFPAHKCICYF

SEQ ID NO: 1292 - protein, 13 aa, Unknown
  Description of Unknown: Anti-microbial peptide
WRWWKVAWRWVKW

SEQ ID NO: 1293 - protein, 70 aa, Unknown
  Description of Unknown: Anti-microbial peptide
FRVKKNADFKAIFRVGLSVSKKLGNAVTRNQIKRRIRHNFKVHKSHLDFVVIARQPAKDMTTLEMEKNLL

SEQ ID NO: 1294 - protein, 9 aa, Unknown
  Description of Unknown: Anti-microbial peptide
RCLCRRRVC

SEQ ID NO: 1295 - protein, 20 aa, Unknown
  Description of Unknown: Anti-microbial peptide
LWETLRRGGRWILAIPREIL

SEQ ID NO: 1296 - protein, 17 aa, Unknown
  Description of Unknown: Anti-microbial peptide
IRLEKARHGSCNYVFPA

SEQ ID NO: 1297 - protein, 70 aa, Unknown
  Description of Unknown: Anti-microbial peptide
YRIKKNADFQRIYRLGISVSKKLGNAVLRNKIKRAIRENFKVHKSHIDIIVIARQPAKDMTTLQIQNSLE

SEQ ID NO: 1298 - protein, 9 aa, Unknown
  Description of Unknown: Anti-microbial peptide
RCLCRRRFC

SEQ ID NO: 1299 - protein, 16 aa, Unknown
  Description of Unknown: Anti-microbial peptide
LRRGGRWILAIPREIL

SEQ ID NO: 1300 - protein, 17 aa, Unknown
  Description of Unknown: Anti-microbial peptide
RLEKARHGSCNYVFPAH

SEQ ID NO: 1301 - protein, 70 aa, Unknown
  Description of Unknown: Anti-microbial peptide
YRIKKDSDFQRIYRLGISVSKKLGNAVLRNKIKRAIREAYRLNIDEKIDIIVIARVSSKDIDKQIQNSLE

SEQ ID NO: 1302 - protein, 18 aa, Unknown
  Description of Unknown: Anti-microbial peptide
WILAIPRRIRGGRLWETL

SEQ ID NO: 1303 - protein, 17 aa, Unknown
  Description of Unknown: Anti-microbial peptide
LEKARHGSCNYVFPAHK

SEQ ID NO: 1304 - protein, 13 aa, Unknown
  Description of Unknown: Anti-microbial peptide
  MOD_RES (2)..(2): Any amino acid
  MOD_RES (5)..(5): Any amino acid
  MOD_RES (9)..(9): Any amino acid
  MOD_RES (12)..(12): Any amino acid
WXWWXVAWXWVXW

SEQ ID NO: 1305 - protein, 70 aa, Unknown
  Description of Unknown: Anti-microbial peptide
KGLKNSEDFRKVYRVGISVSKKVGKAITRNRVRRLIKEVVIAMKDQIDIVFVRAIPPAATASYESIKNLV

SEQ ID NO: 1306 - protein, 9 aa, Unknown
  Description of Unknown: Anti-microbial peptide
RCLCGRRVC

SEQ ID NO: 1307 - protein, 18 aa, Unknown
  Description of Unknown: Anti-microbial peptide
WETLPRRIRGGRLWILAI

SEQ ID NO: 1308 - protein, 17 aa, Unknown
  Description of Unknown: Anti-microbial peptide
EKARHGSCNYVFPAHKC

SEQ ID NO: 1309 - protein, 71 aa, Unknown
  Description of Unknown: Anti-microbial peptide
LRLKHWQDFQTVYRFGITVSQKVSKKATVRNRLKRQIRAVINHFQPQIDVVIIVLPQGIGCNYERFLRELE

SEQ ID NO: 1310 - protein, 9 aa, Unknown
  Description of Unknown: Anti-microbial peptide
RCLCTRRFC

SEQ ID NO: 1311 - protein, 20 aa, Unknown
  Description of Unknown: Anti-microbial peptide
RIRRPIALIWRGGRRLTEWL

SEQ ID NO: 1312 - protein, 17 aa, Unknown
  Description of Unknown: Anti-microbial peptide
KARHGSCNYVFPAHKCI

SEQ ID NO: 1313 - protein, 13 aa, Unknown
  Description of Unknown: Anti-microbial peptide
  MOD_RES (2)..(2): Any amino acid
  MOD_RES (5)..(5): Any amino acid
  MOD_RES (7)..(7): Any amino acid
  MOD_RES (9)..(9): Any amino acid
  MOD_RES (12)..(12): Any amino acid
WXWWXPXWXWPXW

SEQ ID NO: 1314 - protein, 71 aa, Unknown
  Description of Unknown: Anti-microbial peptide
NRLRRREDFAKVYRIGIVVSKKVSKLAVTRNRFKRQLRAIFRQLLSQLQIVVTVTTVASKPNYQELGDDLK

SEQ ID NO: 1315 - protein, 28 aa, Unknown
  Description of Unknown: Anti-microbial peptide
DLWETLKKGGRWILAIPRRIKQGLELTL

SEQ ID NO: 1316 - protein, 17 aa, Unknown
  Description of Unknown: Anti-microbial peptide
ARHGSCNYVFPAHKCIC

SEQ ID NO: 1317 - protein, 70 aa, Unknown
  Description of Unknown: Anti-microbial peptide
ISLKSKIEIQKIFRILVTFSKGFRGSVKRNRIRRLFKEAFRKRLELLDIIFVVSYGKLTLTYFSIESLMK

SEQ ID NO: 1318 - protein, 9 aa, Unknown
  Description of Unknown: Anti-microbial peptide
RCLCVRRVC

SEQ ID NO: 1319 - protein, 27 aa, Unknown
  Description of Unknown: Anti-microbial peptide
LWETLGRVGRWVLAIPRRIRQGLELAL

SEQ ID NO: 1320 - protein, 17 aa, Unknown
  Description of Unknown: Anti-microbial peptide
RHGSCNYVFPAHKCICY

SEQ ID NO: 1321 - protein, 71 aa, Unknown
  Description of Unknown: Anti-microbial peptide
ERLRGSCRVRAVFRFLATFRRGYGKAVARNRARRLSKEAYRALKSSLDLVLLVSVVEDSLAAYQRLLCVLC

SEQ ID NO: 1322 - protein, 9 aa, Unknown
  Description of Unknown: Anti-microbial peptide
RCICGRRIC

SEQ ID NO: 1323 - protein, 21 aa, Unknown
  Description of Unknown: Anti-microbial peptide
YHRLRRLLLIVTRIVELLGRR

SEQ ID NO: 1324 - protein, 17 aa, Unknown
  Description of Unknown: Anti-microbial peptide
HGSCNYVFPAHKCICYF

SEQ ID NO: 1325 - protein, 73 aa, Unknown
  Description of Unknown: Anti-microbial peptide
ARLLKRKQFVYVQKVGITVSKKFGKAHQRNRFKRIVREAFRHVRPNLQVVISPRGNSQPDFLKLSEELLQRIP

SEQ ID NO: 1326 - protein, 9 aa, Unknown
  Description of Unknown: Anti-microbial peptide
RCICRLRVC

SEQ ID NO: 1327 - protein, 21 aa, Unknown
  Description of Unknown: Anti-microbial peptide
YHRLRDLLRIVTRIVELLGRR

SEQ ID NO: 1328 - protein, 18 aa, Unknown
  Description of Unknown: Anti-microbial peptide
IRLEKARHGSCNYVFPAH

SEQ ID NO: 1329 - protein, 20 aa, Unknown
  Description of Unknown: Anti-microbial peptide
KKWWRRALQALKNGLPALIS

SEQ ID NO: 1330 - protein, 73 aa, Unknown
  Description of Unknown: Anti-microbial peptide
ARLLKRKQFVYVQKVGVTVSKKFGKAHQRNRFKRIVREAFRHVRPNLQVVVSPKGGTLPNFGKLSADLLKHIP

SEQ ID NO: 1331 - protein, 9 aa, Unknown
  Description of Unknown: Anti-microbial peptide
RCICRLRFC

SEQ ID NO: 1332 - protein, 23 aa, Unknown
  Description of Unknown: Anti-microbial peptide
  MOD_RES (1)..(3): Any amino acid
  MOD_RES (5)..(6): Any amino acid
  MOD_RES (11)..(14): Any amino acid
  MOD_RES (16)..(19): Any amino acid
XXXIXXVFAKXXXXAXXXXKGIG

SEQ ID NO: 1333 - protein, 30 aa, Unknown
  Description of Unknown: Anti-microbial peptide
GWLRRIGRRIERVGQHKLKKALRALARHWK

SEQ ID NO: 1334 - protein, 7 aa, Unknown
  Description of Unknown: Anti-microbial peptide
HAQYNQR

SEQ ID NO: 1335 - protein, 18 aa, Unknown
  Description of Unknown: Anti-microbial peptide
MAARAAGLAARLAALALR

SEQ ID NO: 1336 - protein, 80 aa, Unknown
  Description of Unknown: Anti-microbial peptide
MKTIILILLILGLGIDAKSLEESKADEEKFLRFIGSVIHGIGHLVHHIGVALGDDQQDNGKFYGYYAEDNGKHWYDTGDQ

SEQ ID NO: 1337 - protein, 16 aa, Unknown
  Description of Unknown: Anti-microbial peptide
ILPWKWPWWPWWPWRR

SEQ ID NO: 1338 - protein, 18 aa, Unknown
  Description of Unknown: Anti-microbial peptide
KNLRRITRKIIHIIKKYG

SEQ ID NO: 1339 - protein, 9 aa, Unknown
  Description of Unknown: Anti-microbial peptide
RHGSCNYVF

SEQ ID NO: 1340 - protein, 14 aa, Unknown
  Description of Unknown: Anti-microbial peptide
KRLFKELLFSLRKY

SEQ ID NO: 1341 - protein, 25 aa, Unknown
  Description of Unknown: Anti-microbial peptide
NQGRHFCGGALIHARFVMTAAKCFQ

SEQ ID NO: 1342 - protein, 20 aa, Unknown
  Description of Unknown: Anti-microbial peptide
YSTGMVHLLLQVTIDGRNYI

SEQ ID NO: 1343 - protein, 13 aa, Unknown
  Description of Unknown: Anti-microbial peptide
ALYKKLFKKLLKR

SEQ ID NO: 1344 - protein, 19 aa, Unknown
  Description of Unknown: Anti-microbial peptide
RRWCFRVCYRGRFCYRKCR

SEQ ID NO: 1345 - protein, 12 aa, Unknown
  Description of Unknown: Anti-microbial peptide
AASYKCLHKRCR

SEQ ID NO: 1346 - protein, 30 aa, Unknown
  Description of Unknown: Anti-microbial peptide
KWKKFIKKIGIGAVLKVLTTGLPALKLTKK

SEQ ID NO: 1347 - protein, 12 aa, Unknown
  Description of Unknown: Anti-microbial peptide
ILKKWPWPWRRK

SEQ ID NO: 1348 - protein, 36 aa, Unknown
  Description of Unknown: Anti-microbial peptide
VRRVWRRVVRVVRRWVRRVRRVWRRVVRVVRRWVRR

SEQ ID NO: 1349 - protein, 26 aa, Unknown
  Description of Unknown: Anti-microbial peptide
KWKLFKKKGTGAVLTVLTTGLPALIS

SEQ ID NO: 1350 - protein, 15 aa, Unknown
  Description of Unknown: Anti-microbial peptide
VGALAVVVWLWLWLW

SEQ ID NO: 1351 - protein, 32 aa, Unknown
  Description of Unknown: Anti-microbial peptide
RFARRFARRFARRFARRFARRFARRFARRFAR

SEQ ID NO: 1352 - protein, 8 aa, Unknown
  Description of Unknown: Anti-microbial peptide
VPKCCKPV

SEQ ID NO: 1353 - protein, 21 aa, Unknown
  Description of Unknown: Anti-microbial peptide
YHRLRDLLLIVRRIVELLGRR

SEQ ID NO: 1354 - protein, 18 aa, Unknown
  Description of Unknown: Anti-microbial peptide
RLEKARHGSCNYVFPAHK

SEQ ID NO: 1355 - protein, 74 aa, Unknown
  Description of Unknown: Anti-microbial peptide
SRVLKRKQFLYITRMGITVSKKFGKAHERNSFKRVVREVFRHVRHQLQIVVFPKGHKQRPVFSKLLQDFINQIP

SEQ ID NO: 1356 - protein, 9 aa, Unknown
  Description of Unknown: Anti-microbial peptide
RCICTLRVC

SEQ ID NO: 1357 - protein, 76 aa, Unknown
  Description of Unknown: Anti-microbial peptide
MAKIFRITGIMSKKGKDPLYFRKEYKALKPEDALEILYSEFGGRYKVKRSRIKILNIEEIKPEDVTDPVLKKLVTA

SEQ ID NO: 1358 - protein, 78 aa, Unknown
  Description of Unknown: Anti-microbial peptide
MKMKTKIFRVKGKFLMGDKLQPFTKELNAIREEEIYERLYSEFGSKHRVPRSKVKIEEIEEISPEEVQDPVVKALVQR

SEQ ID NO: 1359 - protein, 85 aa, Unknown
  Description of Unknown: Anti-microbial peptide
AEVKIFMVRGTAIFSASRFPTSQKFTKYVRALNEKQAIEYIYSQLGGKNKIKRYNIHIQEIKEVKEDEITDKTIRDLAKLDKIIM

SEQ ID NO: 1360 - protein, 70 aa, Unknown
  Description of Unknown: Anti-microbial peptide
AEVKIFMVRGTAIFSASRFPTSQKYVRALNEKQAIEYIYSQLGGKNKINDTTYTYKRSKKLRKMKSQTRQ

SEQ ID NO: 1361 - protein, 21 aa, Unknown
  Description of Unknown: Anti-microbial peptide
YHRLRDLLLIVTRIVRLLGRR

SEQ ID NO: 1362 - protein, 18 aa, Unknown
  Description of Unknown: Anti-microbial peptide
LEKARHGSCNYVFPAHKC

SEQ ID NO: 1363 - protein, 74 aa, Unknown
  Description of Unknown: Anti-microbial peptide
ERLRLRRDFLLIFRLGIVVKRKFGKATRRNKLKRWVREIFRRNKGVIDIVVIPRKKLSEEFERVDFWTVREKLL

SEQ ID NO: 1364 - protein, 9 aa, Unknown
  Description of Unknown: Anti-microbial peptide
RCICTLRFC

SEQ ID NO: 1365 - protein, 85 aa, Unknown
  Description of Unknown: Anti-microbial peptide
VFYKVTLSRSLIGVPHTTKSIVKSLGLGKRGSIVYKKVNPAIAGSLAKVKELVKVEVTEHELTPSQQRELRKSNPGFIVEKRTID

SEQ ID NO: 1366 - protein, 21 aa, Unknown
  Description of Unknown: Anti-microbial peptide
YHRLRDLLLIVTRIVCLLGRR

SEQ ID NO: 1367 - protein, 18 aa, Unknown
  Description of Unknown: Anti-microbial peptide
EKARHGSCNYVFPAHKCI

SEQ ID NO: 1368 - protein, 28 aa, Unknown
  Description of Unknown: Anti-microbial peptide
KWKLFKKIGIGAVLKVLTTGLPALKLTK

SEQ ID NO: 1369 - protein, 97 aa, Unknown
  Description of Unknown: Anti-microbial peptide
VRGSIPLQASAAFPKAARLLKTDEFSSVFRLRPWRRTAHFVIYGKPTGRDARLGLVIGKKYAARAVTRNLVKRLAREAFRTRRAEFAGWDILLRLHA

SEQ ID NO: 1370 - protein, 78 aa, Unknown
  Description of Unknown: Anti-microbial peptide
ERLYLRDEINTVFSMLVSVAKKRFRRAVKRNRVRRLVREAYRLNKHLLDVLQERQIYATIAFMVVSDELPDFRTVERA

SEQ ID NO: 1371 - protein, 9 aa, Unknown
  Description of Unknown: Anti-microbial peptide
RCICVLRVC

SEQ ID NO: 1372 - protein, 69 aa, Unknown
  Description of Unknown: Anti-microbial peptide
VKVKSKNSVIKLLSTAASGYSRYISIKKGAPLVTQVRYDPVVKRHVLFKEAKKRKVAERKPLDFLRTAK

SEQ ID NO: 1373 - protein, 21 aa, Unknown
  Description of Unknown: Anti-microbial peptide
YHRLRDLLLIVRRIVCLLGRR

SEQ ID NO: 1374 - protein, 18 aa, Unknown
  Description of Unknown: Anti-microbial peptide
KARHGSCNYVFPAHKCIC

SEQ ID NO: 1375 - protein, 77 aa, Unknown
  Description of Unknown: Anti-microbial peptide
LRGEREFRKVRRIGLVVSKKTLKHAVKRNRARRRVREALRTMPPELRAILMLNPGVLTVPFPELQAALAQALQRGAG

SEQ ID NO: 1376 - protein, 9 aa, Unknown
  Description of Unknown: Anti-microbial peptide
RCICVLRFC

SEQ ID NO: 1377 - protein, 21 aa, Unknown
  Description of Unknown: Anti-microbial peptide
YHRLLRDLLIVTRIVELLGRR

SEQ ID NO: 1378 - protein, 18 aa, Unknown
  Description of Unknown: Anti-microbial peptide
ARHGSCNYVFPAHKCICY

SEQ ID NO: 1379 - protein, 75 aa, Unknown
  Description of Unknown: Anti-microbial peptide
ARLKGGFLLLIRVLFTVGKKLVPRAVDRNRIKRLMREAYRLEKNILDHQVMLAFLYRARADAIPSLERFRAIRHM

SEQ ID NO: 1380 - protein, 9 aa, Unknown
  Description of Unknown: Anti-microbial peptide
RCLCGLRVC

SEQ ID NO: 1381 - protein, 18 aa, Unknown
  Description of Unknown: Anti-microbial peptide
YHRLRRLLLIVTRIVELL

SEQ ID NO: 1382 - protein, 26 aa, Unknown
  Description of Unknown: Anti-microbial peptide
KWKSFIKKLTSAAKKVLTTGLPALIS

SEQ ID NO: 1383 - protein, 9 aa, Unknown
  Description of Unknown: Anti-microbial peptide
RCLCGLRIC

SEQ ID NO: 1384 - protein, 18 aa, Unknown
  Description of Unknown: Anti-microbial peptide
YHRLRDLLRIVTRIVELL

SEQ ID NO: 1385 - protein, 19 aa, Unknown
  Description of Unknown: Anti-microbial peptide
IRLEKARHGSCNYVFPAHK

SEQ ID NO: 1386 - protein, 26 aa, Unknown
  Description of Unknown: Anti-microbial peptide
KWKLFIKKLTPAVKKVLLTGLPALIS

SEQ ID NO: 1387 - protein, 9 aa, Unknown
  Description of Unknown: Anti-microbial peptide
RCLCTLRVC

SEQ ID NO: 1388 - protein, 18 aa, Unknown
  Description of Unknown: Anti-microbial peptide
YHRLRDLLLIVRRIVELL

SEQ ID NO: 1389 - protein, 19 aa, Unknown
  Description of Unknown: Anti-microbial peptide
RLEKARHGSCNYVFPAHKC

SEQ ID NO: 1390 - protein, 18 aa, Unknown
  Description of Unknown: Anti-microbial peptide
GKPRPYSPIPTSPRPIRY

SEQ ID NO: 1391 - protein, 9 aa, Unknown
  Description of Unknown: Anti-microbial peptide
RCLCTLRIC

SEQ ID NO: 1392 - protein, 18 aa, Unknown
  Description of Unknown: Anti-microbial peptide
YHRLRDLLLIVTRIVRLL

SEQ ID NO: 1393 - protein, 19 aa, Unknown
  Description of Unknown: Anti-microbial peptide
LEKARHGSCNYVFPAHKCI

SEQ ID NO: 1394 - protein, 12 aa, Unknown
  Description of Unknown: Anti-microbial peptide
RLARIVVIRVAR

SEQ ID NO: 1395 - protein, 9 aa, Unknown
  Description of Unknown: Anti-microbial peptide
RCLCVLRVC

SEQ ID NO: 1396 - protein, 77 aa, Unknown
  Description of Unknown: Anti-microbial peptide
MLKIRLKRCGRKKQTSFKIVVMNNLDKRDGQAIEELGFMNPRTKEKYLNINKINHYLRLGAKPTKTVFDLLNKAKII

SEQ ID NO: 1397 - protein, 77 aa, Unknown
  Description of Unknown: Anti-microbial peptide
MVKLRLKRYGRKGQVTYRIVAMNNLSRRDGKAIEELGFYNPRTNESSLNIANIKRRIEQGAQPTNTVRYILAKANIL

SEQ ID NO: 1398 - protein, 85 aa, Unknown
  Description of Unknown: Anti-microbial peptide
MVKLRLKRCGRKQQAVYRIVAIDVRSRREGRDLRKVGFYDPIKNQTCLNVPAILYFLEKGAQPTRTVYDILRKAEFFKEKERTLS

SEQ ID NO: 1399 - protein, 85 aa, Unknown
  Description of Unknown: Anti-microbial peptide
MVKLRLKRCGRKQQAIYRIVAIDVRSRREGRDLRKVGFYDPIKNQTCLNVPAILYFLEKGAQPTRTVYDILRKAEFFKDKERTLS

SEQ ID NO: 1400 - protein, 79 aa, Unknown
  Description of Unknown: Anti-microbial peptide
MLKLRLKRSGRKKQPSYRLVVMENTTRRDGRPVEQVGYYNTITKESYFDVIKIKKWLNYGAKPTQTVLNLLKKAKIIDQ

SEQ ID NO: 1401 - protein, 62 aa, Unknown
  Description of Unknown: Anti-microbial peptide
MLKLRLKRCGRKQRFYDPIKNQTCLNVPAILYFLEKGAQPTRTVSDILRKAEFFKEKERTLS

SEQ ID NO: 1402 - protein, 18 aa, Unknown
  Description of Unknown: Anti-microbial peptide
YHRLRDLLLIVTRIVCLL

SEQ ID NO: 1403 - protein, 19 aa, Unknown
  Description of Unknown: Anti-microbial peptide
EKARHGSCNYVFPAHKCIC

SEQ ID NO: 1404 - protein, 12 aa, Unknown
  Description of Unknown: Anti-microbial peptide
ILRWPWWPWRRK

SEQ ID NO: 1405 - protein, 9 aa, Unknown
  Description of Unknown: Anti-microbial peptide
RCLCVLRIC

SEQ ID NO: 1406 - protein, 82 aa, Unknown
  Description of Unknown: Anti-microbial peptide
MVKLRLKRYGRKQQPSYRIVAMDSRSKRDGKAIEELGFYNPITNETRIDIAKILKRLKQGAQTTRTVKNILNEAQIIAKENS

SEQ ID NO: 1407 - protein, 88 aa, Unknown
  Description of Unknown: Anti-microbial peptide
MVKLRLKRCGRKQRAVYRIVAIDVRSRREGRDLRKVGFYDPITNQTYLNLPAILDFLKKGAQPTRTVHDISKKAGIFTELNLNKTKLN

SEQ ID NO: 1408 - protein, 88 aa, Unknown
  Description of Unknown: Anti-microbial peptide
MVKLRLKRCGRKQRAVYRIVAIDVRSRREGKDLQKVGFYDPIKNQTYLNVPAILYFLEKGAQPTETVQDILKKAEVFKELRLNQPKFN

SEQ ID NO: 1409 - protein, 85 aa, Unknown
  Description of Unknown: Anti-microbial peptide
MVKLRLKRCGRKQRAVYRIVAIDVRSRREGKDLRKVGFYDPIKNQTYLNVPAILYFLEKGAQPTGTVQDILKKAEVFKELRPNQS

SEQ ID NO: 1410 - protein, 88 aa, Unknown
  Description of Unknown: Anti-microbial peptide
MASKERVGVVIRNPQEKTVIVAVNNRVRHNKYSKIIIRTKKYQVHDHSHICKLGDEVKISEVKPISKTKRWIISEVLSSTVNPEKFGD

SEQ ID NO: 1411 - protein, 84 aa, Unknown
  Description of Unknown: Anti-microbial peptide
MPVKEKVGIVVSNKMQKTIVVKVESRYSHPIYSKTMTKTRKYLAHDEMGECNIGDQVLVQECRPLSKRKRWTLSKVLSKSSLVS

SEQ ID NO: 1412 - protein, 83 aa, Unknown
  Description of Unknown: Anti-microbial peptide
MPLKETTGKVVSDKMNKTIVVAVENRISHRKYAKTMTRTKKYKAHDENNECAVGDIVTIQETRPLSRTKCWTMVNILSKSFHN

SEQ ID NO: 1413 - protein, 71 aa, Unknown
  Description of Unknown: Anti-microbial peptide
MSVYRRRLSPLKPNQVIDYQDVELLRTFITDQGKILPRRVTGLTAKQQRAVTKAIKQARVLALLPFVNRES

SEQ ID NO: 1414 - protein, 23 aa, Unknown
  Description of Unknown: Anti-microbial peptide
  MOD_RES (1)..(2): Any amino acid
  MOD_RES (6)..(6): Any amino acid
  MOD_RES (11)..(11): Any amino acid
  MOD_RES (14)..(14): Any amino acid
  MOD_RES (16)..(17): Any amino acid
XXMIEXVFAKXFKXAXXLFKGIG

SEQ ID NO: 1415 - protein, 30 aa, Unknown
  Description of Unknown: Anti-microbial peptide
KLKKALRALARHWKGWLRRIGRRIERVGQH

SEQ ID NO: 1416 - protein, 6 aa, Unknown
  Description of Unknown: Anti-microbial peptide
HPQYNQ

SEQ ID NO: 1417 - protein, 19 aa, Unknown
  Description of Unknown: Anti-microbial peptide
MAARAAGLAARLAALALRA

SEQ ID NO: 1418 - protein, 18 aa, Unknown
  Description of Unknown: Anti-microbial peptide
ILPWKWPWWPWWKKPWRR

SEQ ID NO: 1419 - protein, 18 aa, Unknown
  Description of Unknown: Anti-microbial peptide
KNLRRISRKIIHIIKKYG

SEQ ID NO: 1420 - protein, 9 aa, Unknown
  Description of Unknown: Anti-microbial peptide
CNYVFPAHK

SEQ ID NO: 1421 - protein, 15 aa, Unknown
  Description of Unknown: Anti-microbial peptide
KRKFHEKHHSHRGYC

SEQ ID NO: 1422 - protein, 20 aa, Unknown
  Description of Unknown: Anti-microbial peptide
RHFCGGALIHARFVMTAAHC

SEQ ID NO: 1423 - protein, 10 aa, Unknown
  Description of Unknown: Anti-microbial peptide
IEAYFERIGY

SEQ ID NO: 1424 - protein, 13 aa, Unknown
  Description of Unknown: Anti-microbial peptide
GLYKRLFKKLLKS

SEQ ID NO: 1425 - protein, 12 aa, Unknown
  Description of Unknown: Anti-microbial peptide
AASYACLHAACA

SEQ ID NO: 1426 - protein, 23 aa, Unknown
  Description of Unknown: Anti-microbial peptide
KKWKKFIKKIGIGAVLTTPGAKK

SEQ ID NO: 1427 - protein, 13 aa, Unknown
  Description of Unknown: Anti-microbial peptide
ILKKYPWYPWRRK

SEQ ID NO: 1428 - protein, 48 aa, Unknown
  Description of Unknown: Anti-microbial peptide
RVVRVVRRWVRRVRRVWRRVVRVVRRWVRRVRRVWRRVVRVVRRWVRR

SEQ ID NO: 1429 - protein, 68 aa, Unknown
  Description of Unknown: Anti-microbial peptide
LRCMCIKTTSGIHPKNIQSLEVIGKGTHCNQVEVIATLKDGRKICLDPDAPRIKKIVQKKLAGDESAD

SEQ ID NO: 1430 - protein, 11 aa, Unknown
  Description of Unknown: Anti-microbial peptide
RLCRVVIRVCR

SEQ ID NO: 1431 - protein, 48 aa, Unknown
  Description of Unknown: Anti-microbial peptide
RVVRVVRRWVRRVRRVWRRVVRVVRRWVRRVRRVWRRVVRVVRRWRVV

SEQ ID NO: 1432 - protein, 26 aa, Unknown
  Description of Unknown: Anti-microbial peptide
KWKSFIKKLTSVLKKVVTTAKPLISS

SEQ ID NO: 1433 - protein, 14 aa, Unknown
  Description of Unknown: Anti-microbial peptide
LRRIIRKIIHIIKK

SEQ ID NO: 1434 - protein, 24 aa, Unknown
  Description of Unknown: Anti-microbial peptide
FAKKFAKKFAKKFAKKFAKKFAKK

SEQ ID NO: 1435 - protein, 59 aa, Unknown
  Description of Unknown: Anti-microbial peptide
AQAEPLQARADEAAAQEQPGADDQEMAHAFTWHESAALPLSDSARGLRCICGRGICRLL

SEQ ID NO: 1436 - protein, 18 aa, Unknown
  Description of Unknown: Anti-microbial peptide
YHRLRDLLLIVRRIVCLL

SEQ ID NO: 1437 - protein, 19 aa, Unknown
  Description of Unknown: Anti-microbial peptide
KARHGSCNYVFPAHKCICY

SEQ ID NO: 1438 - protein, 12 aa, Unknown
  Description of Unknown: Anti-microbial peptide
WRWWKVWRWVKW

SEQ ID NO: 1439 - protein, 92 aa, Unknown
  Description of Unknown: Anti-microbial peptide
MYKFKRSFRRRLSPIGSGNLIYYRNMSLISRFISEQGKILSRRVNRLTLKQQRLITIAIKQARILSLLPFINNEKQFERIESITRVKGFIKK

SEQ ID NO: 1440 - protein, 64 aa, Unknown
  Description of Unknown: Anti-microbial peptide
MKYPALIDYKNVNILRRFINFQGKIIPKRLNKPKLTYKQHRLLRKSVKQARYLGLLPFKTKDFF

SEQ ID NO: 1441 - protein, 75 aa, Unknown
  Description of Unknown: Anti-microbial peptide
MNKSKRSSRRRMPPIRSGEIIDYKNISLLRRFVSEQGKILSRRMNRLTSKQQRLLTIAIKRARVLALLPFLNNEN

SEQ ID NO: 1442 - protein, 72 aa, Unknown
  Description of Unknown: Anti-microbial peptide
MLAQKQKLSPISVNQKIDYKDIDLLKLFITEQGKILPRRATGVTVQQQRQIAKAIKRARVLSLLPFVASNSI

SEQ ID NO: 1443 - protein, 70 aa, Unknown
  Description of Unknown: Anti-microbial peptide
MAVYRKKISPIKPTEAVDYKDIDLLRKFITEQGKILPKRSTGLTSKQQKKLTKAIKQARILSLLPFLNKD

SEQ ID NO: 1444 - protein, 18 aa, Unknown
  Description of Unknown: Anti-microbial peptide
YHRLLRDLLIVTRIVELL

SEQ ID NO: 1445 - protein, 13 aa, Unknown
  Description of Unknown: Anti-microbial peptide
WRWWKVVWRWVKW

SEQ ID NO: 1446 - protein, 118 aa, Unknown
  Description of Unknown: Anti-microbial peptide
VTPAMRTFALLTAMLLLVALAQAEPLQARADEAAAQEQSDSARGLRCICGRGICRLLRRFGSCAFRGTLHRVCCRTCRIKKNKLRIYFESKKFLLLLYLVLHFLFSSKINTLLQDFSL

SEQ ID NO: 1447 - protein, 92 aa, Unknown
  Description of Unknown: Anti-microbial peptide
MARSLKKAPFVANHLLEKVERLNTQGDKKVIKTWSRSSTIVPLMIGHTIAVHNGREHIPVFITDQMVGHKLGEFAPTRTFRGHVKKDKKSKR

SEQ ID NO: 1448 - protein, 92 aa, Unknown
  Description of Unknown: Anti-microbial peptide
MARSLKKGPFIAHHLLKKVELLNTSGKTEVIKTWSRASTILPMMVGHTIAVHNGRQHLPVFITDQMVGHKLGEFAPTRTFKGHTKSDKKARR

SEQ ID NO: 1449 - protein, 94 aa, Unknown
  Description of Unknown: Anti-microbial peptide
MIHSPTLKKNLFVANHLRAKINKLNNKKKKEIIVTWSRASTIIPIMIGHMISIHNGKEHLPIYITDHMVGHKLGEFVPTLNFRGHAKSDNRSRR

SEQ ID NO: 1450 - protein, 94 aa, Unknown
  Description of Unknown: Anti-microbial peptide
MSRSLKKGPFVFYSLIKKVDQMNSNRFKSVILTWSRSCTIIPIMIGNTIGVYNGKEHIPVLVSDQMIGHKLGEFVQTRNYRGHKKHDKKTKTKR

SEQ ID NO: 1451 - protein, 92 aa, Unknown
  Description of Unknown: Anti-microbial peptide
TRKKTNPFVARHLLAKIEKVNMKEEKEIIVTWSRASSILPAMVGHTIAIHNGKEHIPIYITNPMVGRKLGEFVPTRHFTSYESTRKDTKSRR

SEQ ID NO: 1452 - protein, 91 aa, Unknown
  Description of Unknown: Anti-microbial peptide
TRSIKKGPFVADHLLKKIENLNLKKEKKIIITWSRASTIVPTMIGHTIAVHNGQEHLPIYITDRMVGHKLGEFAPTRTFRGHAKNDKKSRR

SEQ ID NO: 1453 - protein, 92 aa, Unknown
  Description of Unknown: Anti-microbial peptide
MPRSLKKGPFVAYHLLKKIDKMNASGKKDVITTWSRTSTILPTMVGHTIAVYNGRQHVPIFISDQLVGHKLGEFVSTRTFKSHIKTDKKTKR

SEQ ID NO: 1454 - protein, 92 aa, Unknown
  Description of Unknown: Anti-microbial peptide
TRKKTNPFVAHHLLAKIEKVNMKEEKETIVTWSRASSILPAMVGHTIAIHNGKEHIPIYITNPMVGRKLGEFVPTRHFTSYESARKDTKSRR

SEQ ID NO: 1455 - protein, 91 aa, Unknown
  Description of Unknown: Anti-microbial peptide
TRSRKKNPFVANHLLKKIKKLNTKGEKAIIKTWSRKSTIIPIMIGHTIAIHNGKEHLPVYITDRMVGHKLGEFSPTLNFGGFAKNDNKSRR

SEQ ID NO: 1456 - protein, 92 aa, Unknown
  Description of Unknown: Anti-microbial peptide
MARSLKKNPFVANHSLRKIKNLNIKEEKKIIVTWSRASVIVPAMIGHTIAVHNGREHLPIYVTDRMVDHKLGEFAPTLLFQGHARNDKKSRR

SEQ ID NO: 1457 - protein, 18 aa, Unknown
  Description of Unknown: Anti-microbial peptide
YHRLRDLLLIVTRIVELL

SEQ ID NO: 1458 - protein, 20 aa, Unknown
  Description of Unknown: Anti-microbial peptide
IRLEKARHGSCNYVFPAHKC

SEQ ID NO: 1459 - protein, 92 aa, Unknown
  Description of Unknown: Anti-microbial peptide
MSRSIHKGPFIDVSLLTRIEALNTSGKKEVIKTWSRASTIIPDMIGHTIAVYNGKQHFPVFVSDQMVGHKLGEFVPTRTFRTHVKGDRKARR

SEQ ID NO: 1460 - protein, 92 aa, Unknown
  Description of Unknown: Anti-microbial peptide
TRKKTNPFVAHHLLAKIEKVNMKEEKETIVTWSRASSILPTMVGHTIAIHNGKEHIPIYITNPMVGRKLGEFVPTRHFTSYENARKDTKSRR

SEQ ID NO: 1461 - protein, 91 aa, Unknown
  Description of Unknown: Anti-microbial peptide
TRSLKKNPFVANHLLRKINKLNTKAEKDIIITWSRASTIIPTMIGHTIAIHNGKEHLPIYITDRMVGHKLGEFSPTLNFRGHAKNDNRSRR

SEQ ID NO: 1462 - protein, 91 aa, Unknown
  Description of Unknown: Anti-microbial peptide
TRSLKKNPFVANHLLRKIEKLNKKAEKEIIVTWSRASTIIPTMIGHTIAIHNGREHLPIYITDRMVGHKLGEFAPTLNFRGHAKNDNKSRR

SEQ ID NO: 1463 - protein, 91 aa, Unknown
  Description of Unknown: Anti-microbial peptide
TRSLKKNPFVANHLLKKIDKLNTKAEKEIIVTWSRASTIIPTMIGHTIAIHNGKEHLPIYITDSMVGHKLGEFAPTLNFRGHAKSDNRSRR

SEQ ID NO: 1464 - protein, 95 aa, Unknown
  Description of Unknown: Anti-microbial peptide
MANTKSAIKRIKTIERNRIRNCAYKSVVKTFIKKYLKVLSDYTNAPNSNGVENIQTTLGIVYTKIDKAVKRGVYHSNKAARMKSKLALKYNVIKK

SEQ ID NO: 1465 - protein, 93 aa, Unknown
  Description of Unknown: Anti-microbial peptide
MANNASAEKRILINERNRLQNRFYKSSVRTLTKLYLKDLEVYKISRNPSDKEKAKNRLSLVYSLIDKGSKRNVFHKNTAARKKSKLASQLKIA

SEQ ID NO: 1466 - protein, 94 aa, Unknown
  Description of Unknown: Anti-microbial peptide
MAKNLSAIKRIKTSERNRLINRKYKSVVKTLTKRCLMNIENLENSNLNDVQLSISQVYSKIDKAIKKGAFHPNTGARKKARLARIFAYAQKQQN

SEQ ID NO: 1467 - protein, 21 aa, Unknown
  Description of Unknown: Anti-microbial peptide
RRGLLEVIRTVILPRRLLDRL

SEQ ID NO: 1468 - protein, 20 aa, Unknown
  Description of Unknown: Anti-microbial peptide
RLEKARHGSCNYVFPAHKCI

SEQ ID NO: 1469 - protein, 141 aa, Unknown
  Description of Unknown: Anti-microbial peptide
VTPAMRTFALLTAMLLLVALAQAEPLQARADEAAAQEQPGADDQEMAHAFTWHESAALPLSSDSARGLRCICGRRICRLLRRFGSCAFRGTLHRICCRACRIKKHKLRIYFESKKFLLLLYLVLHFLFSSKINTLLQDFSL

SEQ ID NO: 1470 - protein, 103 aa, Unknown
  Description of Unknown: Anti-microbial peptide
MKTITIPRQNLTQYEIMLIMRPDLPEEKFLKFLSEIKEHAKRNLALEFNLSNRGRRKLAYAMRKFQDGIYIQFNFLGSGYILNSLIKRLKLEESILRYIVQKT

SEQ ID NO: 1471 - protein, 104 aa, Unknown
  Description of Unknown: Anti-microbial peptide
MQVITLQKPSKKITYRTTYILKPSLTEEEITKEIEDYQKLLIDNGAEDIIIENTGKCRLAYLINKQNDGIYFQITYRGANTLVNILQRRMRLSINTLRYQTFKV

SEQ ID NO: 1472 - protein, 96 aa, Unknown
  Description of Unknown: Anti-microbial peptide
MSATKKYEMMILLTEEFNDSELKTWAFNYAKALRKLSASEISVISRGKRDLSYYINNQKKGNFIQINFSSMPKYVDNFSKNLKFDSNVLRFLILNK

SEQ ID NO: 1473 - protein, 112 aa, Unknown
  Description of Unknown: Anti-microbial peptide
MLQTKNSQEIKLNWYETVYLIKSDLNEDRTLCIINEYKSMLTNGGAKNIILQHRGRRHLSYSIKDYRDGIYVQVNYEGNGKLVQSFEKSLRFDENIIRYLTNKQNKDNKIEG

SEQ ID NO: 1474 - protein, 18 aa, Unknown
  Description of Unknown: Anti-microbial peptide
YHRLRDLALIVTRIVELL

SEQ ID NO: 1475 - protein, 20 aa, Unknown
  Description of Unknown: Anti-microbial peptide
LEKARHGSCNYVFPAHKCIC

SEQ ID NO: 1476 - protein, 18 aa, Unknown
  Description of Unknown: Anti-microbial peptide
RRGLLRVIRTVILALDIL

SEQ ID NO: 1477 - protein, 20 aa, Unknown
  Description of Unknown: Anti-microbial peptide
EKARHGSCNYVFPAHKCICY

SEQ ID NO: 1478 - protein, 141 aa, Unknown
  Description of Unknown: Anti-microbial peptide
VTPAMRTFALLTAMLLLVALAQAEPLQARADEAAAQEQPGADDQEMAHAFTWHESAALPLSSDSARGLRCICGRGICRLLRRFGSCAFRGTLHRICCRACRIKKHKLRIYFESKKFLLLLYLVLHFLFSSKINTLLQDFSL

SEQ ID NO: 1479 - protein, 21 aa, Unknown
  Description of Unknown: Anti-microbial peptide
RRGLLEVIRTVILLLDRLRHY

SEQ ID NO: 1480 - protein, 18 aa, Unknown
  Description of Unknown: Anti-microbial peptide
GICRCICGKGICRCYCGR

SEQ ID NO: 1481 - protein, 101 aa, Unknown
  Description of Unknown: Anti-microbial peptide
AKQKIRIRLKAYDHRILDQSAEKIVETAKRSGASVSGPIPLPTEKSVYTILLAVHKYKDSREQFEMRTHKRLIDIVNPTPQTVDALMRLDLPSGVDIEIKL

SEQ ID NO: 1482 - protein, 103 aa, Unknown
  Description of Unknown: Anti-microbial peptide
MIAKDKIRVRLFSFDVKILDQSAESIVKAVQKAKAQIKGPIPLPTKIKKYTVLRSPHVNKKSREQFEMRTHKRLIDILEPTSALMDSLMKLELPAGVEVDIKQ

SEQ ID NO: 1483 - protein, 21 aa, Unknown
  Description of Unknown: Anti-microbial peptide
RRGLLEVIRTVILALDRLRHY

SEQ ID NO: 1484 - protein, 18 aa, Unknown
  Description of Unknown: Anti-microbial peptide
GICKCICGKGICKCICGR

SEQ ID NO: 1485 - protein, 103 aa, Unknown
  Description of Unknown: Anti-microbial peptide
MQNQRIRIRLKAFDHRLIDQATAEIVETAKRTGAQVRGPIPLPTRKERFTVLISPHVNKDARDQYEIRTHLRLVDIVEPTEKTVDALMRLDLAAGVDVQISLG

SEQ ID NO: 1486 - protein, 104 aa, Unknown
  Description of Unknown: Anti-microbial peptide
MEKIRLKLKAYDHRVLDRSVVAIVEAVKRSGSEIRGPIPLPTKNKRYTVLRSPHVNKDSREQFEIRVYSRLIDIISATPETVDSLMKLDLAPEVDVEVTSMETK

SEQ ID NO: 1487 - protein, 106 aa, Unknown
  Description of Unknown: Anti-microbial peptide
MRGESMQRARIKLSSTDHKVLDEICRQIKEIAEKTGVDISGPIPLPTKVLRVVTRKSPDGEGSSTFDRWTMKIHKRLIDIDADERALRHIMKIRIPDNVQIEIQFK

SEQ ID NO: 1488 - protein, 102 aa, Unknown
  Description of Unknown: Anti-microbial peptide
MHKARIKLTGTDPEKLAYVCDQLKKIAERTGVDMSGPIPLPTKRLVVPTRKSPDGEGTATWEKWEMRIHKRLVGIEADERAMRQVMKVNVPDNVSIEIELKS

SEQ ID NO: 1489 - protein, 91 aa, Unknown
  Description of Unknown: Anti-microbial peptide
MQKARIKLSSTKHEELDSVCNQIKAIAEKTGVDMAGPIPLPTKSLKITTRKSTDGEGSSSFDRWTMRVHKRVIDIEADERTMKHIMKVKNS

SEQ ID NO: 1490 - protein, 102 aa, Unknown
  Description of Unknown: Anti-microbial peptide
MAENKMRIKLKGYDHAIVDQSITKIIQAAEGTGAKVRGPIPLPTEKQVITILRAVHKYKDSREQFEMRTHKRLLEILNPTAATMDVLKRVQLPSGVDIEIKL

SEQ ID NO: 1491 - protein, 106 aa, Unknown
  Description of Unknown: Anti-microbial peptide
MNSAVKYPELKIKLESYDSTLLDLTIKKIVEVVKGVNIKIKGPLPLPTKKEVITIIRSPHVDKASREQFEKNTHKRLMILVDVNQGGIDSLKKIKIPVGVTLRFSK

SEQ ID NO: 1492 - protein, 101 aa, Unknown
  Description of Unknown: Anti-microbial peptide
MAGQKIRIRLKAYDHEAIDASARKIVETVVRTGANVVGPVPLPTEKNVYCVIRSPHKYKDSREHFEMRTHKRLIDILDPTPKTVDALMRIDLPASVDVNIQ

SEQ ID NO: 1493 - protein, 18 aa, Unknown
  Description of Unknown: Anti-microbial peptide
RRGLLEVIRTVILALDRL

SEQ ID NO: 1494 - protein, 18 aa, Unknown
  Description of Unknown: Anti-microbial peptide
GICRCICGKRICRCICGR

SEQ ID NO: 1495 - protein, 108 aa, Unknown
  Description of Unknown: Anti-microbial peptide
MNAANAVKYPELKIKLESYDSTLLDLTTKKIVEVVKGVDVKIKGPLPLPTKKEVITIIRSPHVDKASREQFEKNRHKRLMILVDVNQGAIDSLKRIKIPVGVTLRFSK

SEQ ID NO: 1496 - protein, 101 aa, Unknown
  Description of Unknown: Anti-microbial peptide
MAGQKIRIRLKAYDHEAIDASARKIVETVVRTGASVVGPVPLPTEKNVYCVIRSPHKYKDSREHFEMRTHKRLIDIIDPTPKTVDALMRIDLPASVDVNIQ

SEQ ID NO: 1497 - protein, 103 aa, Unknown
  Description of Unknown: Anti-microbial peptide
MQTQKIRIRLKAYDYALIDRSAQEIVETAKRTGAVVKGPIPLPTKIERFNILRSPHMNKTSREQLEIRTHLRLMDIVDWTDKTTDALMKLDLPAGVDVEIKVQ

SEQ ID NO: 1498 - protein, 102 aa, Unknown
  Description of Unknown: Anti-microbial peptide
MAGQKIRIRLKAYDHEVIDSSAKKIVETVTRTGAKVAGPVPLPTEKNVYCVIRSPHNDKDSREHFEMRTHKRLIDIIDPTPKTVDSLMRLDLPAGVDISIKL

SEQ ID NO: 1499 - protein, 102 aa, Unknown
  Description of Unknown: Anti-microbial peptide
MQKARIKIASTNVRSLDEVANQIKQIAERTGVRMSGPIPLPTKRIRITTRKSPDGEGSATFDRWELRVHKRLIDIEADERAMRQIMRIRVPEDVTIEIELIS

SEQ ID NO: 1500 - protein, 105 aa, Unknown
  Description of Unknown: Anti-microbial peptide
MKNKIKIRLKSFDHRSLDQATKEIVSAVKRTFATINGPIPLPRKIERFTVNRSPHVHKKSREQFEIRKHKRLLVIDDPNPAVVDALSKVDLAAGVDVVIELESGE

SEQ ID NO: 1501 - protein, 105 aa, Unknown
  Description of Unknown: Anti-microbial peptide
MATIQQQKIRIRLKAFDRRLLDTSCEKIVDTANRTGATALGPIPLPTKRRIYCVLRSPHVDKDSREHFETRTHRRIIDIYQPSSKTIDALMKLDLPAGVDIEVKL

SEQ ID NO: 1502 - protein, 102 aa, Unknown
  Description of Unknown: Anti-microbial peptide
MANKKIRIRLKAYEHRTLDTAAEKIVETATRTGASVAGPVPLPTERSLYTVIRATHKYKDSREQFEMRTHKRLIDIVNPTQKTVDALMKLDLPSGVNVEIKL

SEQ ID NO: 1503 - protein, 102 aa, Unknown
  Description of Unknown: Anti-microbial peptide
MPTKARIRLWSSNIDSLNFVVNQIRNMAQKTGIQVSGPIPLPTTRMEVPVMRLPHGEGKKKWEHWEMKVHKRIIDIAADERVMRQLMRVRVPDDVYIEIELI

SEQ ID NO: 1504 - protein, 18 aa, Unknown
  Description of Unknown: Anti-microbial peptide
YHRLRDLLLIVCRIVELL

SEQ ID NO: 1505 - protein, 6 aa, Unknown
  Description of Unknown: Anti-microbial peptide
CICYFP

SEQ ID NO: 1506 - protein, 18 aa, Unknown
  Description of Unknown: Anti-microbial peptide
GICRCICGKKICRCICGR

SEQ ID NO: 1507 - protein, 102 aa, Unknown
  Description of Unknown: Anti-microbial peptide
MPTKARIRLWSTNVENLNYVITQIRGIVEKTGIEMRGPIPLPTSKLEVPIMRLPHGEGRKKWEKWEMRVHKRLIDIAADERVMRQLMRVRVPEDVYIEIQLI

SEQ ID NO: 1508 - protein, 105 aa, Unknown
  Description of Unknown: Anti-microbial peptide
MATLQQQKIRIRLKAFDRRLLDTSCDKIVDTANRTNAAAVGPIPLPTKRKIYCVLRSPHVDKDSREHFETRTHRRIIDIYQPSSKTIDALMKLDLPAGVDIEVKL

SEQ ID NO: 1509 - protein, 104 aa, Unknown
  Description of Unknown: Anti-microbial peptide
MVSYKARISLSGTEHRVVDRVCNEIKEIASRTGVEIHGPMPLPTKRLVVPVRKSPDGEGTNTWDHWEMRIHKRLIDVDADERTLRQLMRIPIPDGVQIEIQIKS

SEQ ID NO: 1510 - protein, 102 aa, Unknown
  Description of Unknown: Anti-microbial peptide
MPGQKIRIKLKAYDHELLDESAKKIVEVAKSTNSKVSGPIPLPTERTLYCVLRSPMKHKDSREHFEKRVHKRLIDIIDPSPKTIDALMRINLPAGVDVEIKL

SEQ ID NO: 1511 - protein, 104 aa, Unknown
  Description of Unknown: Anti-microbial peptide
PKIRIKLRGFDHKTLDASAQKIVEAARRSGAQVSGPIPLPTRVRRFTVIRGPFKHKDSREHFELRTHNRLVDIINPNRKTIEQLMTLDLPTGVEIEIKTVGGGR

SEQ ID NO: 1512 - protein, 101 aa, Unknown
  Description of Unknown: Anti-microbial peptide
MKEQKIRVKLKAFDIELIDQSAQSIVASVKKTGARVSGPIPLPTSIRKVTVIRSPHVNIKSREQFEMRIYKRLIDIFDVTPQTTESLKKLALPAGVDVQLK

SEQ ID NO: 1513 - protein, 31 aa, Unknown
  Description of Unknown: Anti-microbial peptide
RPGGQIAIAIGESIRKKASNELKKATKSLWS

SEQ ID NO: 1514 - protein, 23 aa, Unknown
  Description of Unknown: Anti-microbial peptide
AIAKFAKKALKSMLALMGEAVQT

SEQ ID NO: 1515 - protein, 21 aa, Unknown
  Description of Unknown: Anti-microbial peptide
RVISVVQGACRAIRRIPRRIR

SEQ ID NO: 1516 - protein, 8 aa, Unknown
  Description of Unknown: Anti-microbial peptide
RHPQYNQR

SEQ ID NO: 1517 - protein, 20 aa, Unknown
  Description of Unknown: Anti-microbial peptide
MAARAAGLAARLAALALRAL

SEQ ID NO: 1518 - protein, 14 aa, Unknown
  Description of Unknown: Anti-microbial peptide
ILPWICPWRPSKAN

SEQ ID NO: 1519 - protein, 18 aa, Unknown
  Description of Unknown: Anti-microbial peptide
KNLRRIERKIIHIIKKYG

SEQ ID NO: 1520 - protein, 9 aa, Unknown
  Description of Unknown: Anti-microbial peptide
FPAHKCICY

SEQ ID NO: 1521 - protein, 15 aa, Unknown
  Description of Unknown: Anti-microbial peptide
YGRHSHHKEHFKRKC

SEQ ID NO: 1522 - protein, 20 aa, Unknown
  Description of Unknown: Anti-microbial peptide
RHFCGGALIHARFVMTAARC

SEQ ID NO: 1523 - protein, 20 aa, Unknown
  Description of Unknown: Anti-microbial peptide
LFHLSVDNEHRGQGIAKALV

SEQ ID NO: 1524 - protein, 13 aa, Unknown
  Description of Unknown: Anti-microbial peptide
ALYKRLFKKLKKF

SEQ ID NO: 1525 - protein, 12 aa, Unknown
  Description of Unknown: Anti-microbial peptide
RKSYKALHKRAR

SEQ ID NO: 1526 - protein, 13 aa, Unknown
  Description of Unknown: Anti-microbial peptide
ILKKFPWFPWRRK

SEQ ID NO: 1527 - protein, 28 aa, Unknown
  Description of Unknown: Anti-microbial peptide
RVIEVVQGACRAIRHIPRRIRQGLERIL

SEQ ID NO: 1528 - protein, 70 aa, Unknown
  Description of Unknown: Anti-microbial peptide
AELRCMCIKTTSGIHPKNIQSLEVIGKGTHCNQVEVIATLKDGRKICLDPDAPRIKKIVQKKLAGDESAD

SEQ ID NO: 1529 - protein, 26 aa, Unknown
  Description of Unknown: Anti-microbial peptide
  MOD_RES (26)..(26): Any amino acid
KWKLFKKIGIGAVLKVLTTGLPALIX

SEQ ID NO: 1530 - protein, 26 aa, Unknown
  Description of Unknown: Anti-microbial peptide
KKKSFIKLLTSAKVSVLTTAKPLISS

SEQ ID NO: 1531 - protein, 24 aa, Unknown
  Description of Unknown: Anti-microbial peptide
AKKFAKKFAKKFAKKFAKKFAKKF

SEQ ID NO: 1532 - protein, 97 aa, Unknown
  Description of Unknown: Anti-microbial peptide
MRIIALLAAILLVALQVRAGPLQARGDEAPGQEQRGPEDQDISISFAWDKSSALQVSGSTRGMVCSCRLVFCRRTELRVGNCLIGGVSFTYCCTRVD

SEQ ID NO: 1533 - protein, 21 aa, Unknown
  Description of Unknown: Anti-microbial peptide
YHRLRDLLLIVCRIVELLGRR

SEQ ID NO: 1534 - protein, 6 aa, Unknown
  Description of Unknown: Anti-microbial peptide
ICYFPC

SEQ ID NO: 1535 - protein, 18 aa, Unknown
  Description of Unknown: Anti-microbial peptide
GICRCICGRKICRCICGR

SEQ ID NO: 1536 - protein, 21 aa, Unknown
  Description of Unknown: Anti-microbial peptide
YHRLRDLLLIVTRIVELLGRR

SEQ ID NO: 1537 - protein, 12 aa, Unknown
  Description of Unknown: Anti-microbial peptide
VFPAHKCICYFP

SEQ ID NO: 1538 - protein, 18 aa, Unknown
  Description of Unknown: Anti-microbial peptide
GICRCICGRRICKCICGR

SEQ ID NO: 1539 - protein, 18 aa, Unknown
  Description of Unknown: Anti-microbial peptide
RRGLLEVIRCVILLLDRL

SEQ ID NO: 1540 - protein, 12 aa, Unknown
  Description of Unknown: Anti-microbial peptide
FPAHKCICYFPC

SEQ ID NO: 1541 - protein, 18 aa, Unknown
  Description of Unknown: Anti-microbial peptide
GICKCICGRRICRCICGR

SEQ ID NO: 1542 - protein, 18 aa, Unknown
  Description of Unknown: Anti-microbial peptide
RRGLLRVIRTVILLLDRL

SEQ ID NO: 1543 - protein, 6 aa, Unknown
  Description of Unknown: Anti-microbial peptide
QKLCQR

SEQ ID NO: 1544 - protein, 18 aa, Unknown
  Description of Unknown: Anti-microbial peptide
GICRCICGRRICRCICGK

SEQ ID NO: 1545 - protein, 18 aa, Unknown
  Description of Unknown: Anti-microbial peptide
RRGLLEVIRTVILLLRRL

SEQ ID NO: 1546 - protein, 6 aa, Unknown
  Description of Unknown: Anti-microbial peptide
KLCQRP

SEQ ID NO: 1547 - protein, 18 aa, Unknown
  Description of Unknown: Anti-microbial peptide
GVCRCICGRGVCRCICRR

SEQ ID NO: 1548 - protein, 21 aa, Unknown
  Description of Unknown: Anti-microbial peptide
RRGLLEVIRCVILLLDRLRHY

SEQ ID NO: 1549 - protein, 6 aa, Unknown
  Description of Unknown: Anti-microbial peptide
LCQRPS

SEQ ID NO: 1550 - protein, 18 aa, Unknown
  Description of Unknown: Anti-microbial peptide
GVCRCICGRGVCRCICGR

SEQ ID NO: 1551 - protein, 21 aa, Unknown
  Description of Unknown: Anti-microbial peptide
RRGLLRVIRTVILLLDRLRHY

SEQ ID NO: 1552 - protein, 9 aa, Unknown
  Description of Unknown: Anti-microbial peptide
QKLCQRPSG

SEQ ID NO: 1553 - protein, 9 aa, Unknown
  Description of Unknown: Anti-microbial peptide
  MOD_RES (2)..(2): Any amino acid
  MOD_RES (6)..(7): Any amino acid
RXICGXXIC

SEQ ID NO: 1554 - protein, 21 aa, Unknown
  Description of Unknown: Anti-microbial peptide
RRGLLEVIRTVILLLRRLRHY

SEQ ID NO: 1555 - protein, 9 aa, Unknown
  Description of Unknown: Anti-microbial peptide
KLCQRPSGT

SEQ ID NO: 1556 - protein, 18 aa, Unknown
  Description of Unknown: Anti-microbial peptide
GICYCICGKGICRCICGR

SEQ ID NO: 1557 - protein, 20 aa, Unknown
  Description of Unknown: Anti-microbial peptide
YHKLKLLLIVTKIVELLGKK

SEQ ID NO: 1558 - protein, 9 aa, Unknown
  Description of Unknown: Anti-microbial peptide
LCQRPSGTW

SEQ ID NO: 1559 - protein, 18 aa, Unknown
  Description of Unknown: Anti-microbial peptide
GICRCICGRYICRCICGR

SEQ ID NO: 1560 - protein, 61 aa, Unknown
  Description of Unknown: Anti-microbial peptide
MAKKSMIIKQKRTPKFKVRAYTRCERCGRPHSVYRKFKLCRICFRELAYKGQLPGIKKASW

SEQ ID NO: 1561 - protein, 60 aa, Unknown
  Description of Unknown: Anti-microbial peptide
AKKSMIAKQQRTPKFKVQEYTRCERCGRPHSVIRKFKLCRICFRELAYKGQIPGVKKASW

SEQ ID NO: 1562 - protein, 100 aa, Unknown [sequence omitted]

SEQ ID NO: 1563 - protein, 100 aa, Unknown
  Description of Unknown: Anti-microbial peptide
AKQSMKARDVKRVKLAEKFYAKRVELKKIISDVNASDEDRWDAVLKLQTLPRDSSPSRQRNRCRQTGRPHGVLRKFGLSRIKVREAAMRGEIPGLKKASW

SEQ ID NO: 1564 - protein, 61 aa, Unknown
  Description of Unknown: Anti-microbial peptide
MAKKSMIAKAQRKPKFQVRAYTRCRICGRPHSVYRDFGLCRVCLRKMGSEGLIPGLRKASW

SEQ ID NO: 1565 - protein, 22 aa, Unknown
  Description of Unknown: Anti-microbial peptide
FLIRQLIRQLLTWQPILQYILQ

SEQ ID NO: 1566 - protein, 12 aa, Unknown
  Description of Unknown: Anti-microbial peptide
QKLCQRPSGTWS

SEQ ID NO: 1567 - protein, 18 aa, Unknown
  Description of Unknown: Anti-microbial peptide
RYICRCICGRGICRCICG

SEQ ID NO: 1568 - protein, 53 aa, Unknown
  Description of Unknown: Anti-microbial peptide
MAKKPWKKKYGYGIRPCQRCGHVGPGLIRKYGLNLCRQCFREIAHKLGFKKLD

SEQ ID NO: 1569 - protein, 50 aa, Unknown
  Description of Unknown: Anti-microbial peptide
MIVLPRKYGKASRKCSRCGDHSALVRRYGLMLCRQCFRELAPKIGFKKYN

SEQ ID NO: 1570 - protein, 53 aa, Unknown
  Description of Unknown: Anti-microbial peptide
MTKEPFKTKYGQGSKVCKRCGRKGPGIIRKYGLDLCRQCFRELAPKLGFKKYD

SEQ ID NO: 1571 - protein, 60 aa, Unknown
  Description of Unknown: Anti-microbial peptide
MAKKSLKVKQAKHPKFNVRNYTRCNHCGRPHAVLKKFGICRLCFRKFAYEGQIPGIKKAS

SEQ ID NO: 1572 - protein, 61 aa, Unknown
  Description of Unknown: Anti-microbial peptide
MAKKSLKVKQSRPNKFSVRDYTRCLRCGRARAVLSHFGVCRLCFRELAYAGAIPGVKKASW

SEQ ID NO: 1573 - protein, 61 aa, Unknown
  Description of Unknown: Anti-microbial peptide
MAKKALVNKAARKPKFTVRGYTRCSKCGRPRAVFRKFGLCRICLREMAHAGELPGVQKSSW

SEQ ID NO: 1574 - protein, 61 aa, Unknown
  Description of Unknown: Anti-microbial peptide
MAKKSLKVKQTRIPKFAVRAYTRCQRCGRARAVLSHFGVCRLCFRELAYAGAIPGVKKASW

SEQ ID NO: 1575 - protein, 37 aa, Unknown
  Description of Unknown: Anti-microbial peptide
KAIQTAQGVVAVAPGAKIIGDRINQGVKEIKKFLKWK

SEQ ID NO: 1576 - protein, 23 aa, Unknown
  Description of Unknown: Anti-microbial peptide
AIAIFKRIAKINFKALMGEAVQT

SEQ ID NO: 1577 - protein, 33 aa, Unknown
  Description of Unknown: Anti-microbial peptide
  MOD_RES (3)..(4): Any amino acid
  MOD_RES (6)..(6): Any amino acid
  MOD_RES (17)..(18): Any amino acid
  MOD_RES (28)..(28): Any amino acid
YCXXNXGHCHPIRCPGXXRQIGTCHGZXHKCCR

SEQ ID NO: 1578 - protein, 15 aa, Unknown
  Description of Unknown: Anti-microbial peptide
SRAAGLAARLARLAL

SEQ ID NO: 1579 - protein, 13 aa, Unknown
  Description of Unknown: Anti-microbial peptide
IVPWKWTLWPWRR

SEQ ID NO: 1580 - protein, 33 aa, Unknown
  Description of Unknown: Anti-microbial peptide
  MOD_RES (1)..(1): Any amino acid
  MOD_RES (3)..(4): Any amino acid
  MOD_RES (6)..(6): Any amino acid
  MOD_RES (8)..(8): Any amino acid
  MOD_RES (10)..(10): Any amino acid
  MOD_RES (17)..(18): Any amino acid
  MOD_RES (25)..(25): Any amino acid
  MOD_RES (27)..(29): Any amino acid
XCXXNXGXCXPIRCPGXXRQIGTCXGXXXLCCR

SEQ ID NO: 1581 - protein, 39 aa, Unknown
  Description of Unknown: Anti-microbial peptide
ATCENLANTYRGPCFGGCDFHCKTKEHLLSGRCRDDFRC

SEQ ID NO: 1582 - protein, 18 aa, Unknown
  Description of Unknown: Anti-microbial peptide
KNLRRIDRKIIHIIKKYG

SEQ ID NO: 1583 - protein, 9 aa, Unknown
  Description of Unknown: Anti-microbial peptide
PAHKCICYF

SEQ ID NO: 1584 - protein, 20 aa, Unknown
  Description of Unknown: Anti-microbial peptide
RHFCGGALIHARFVMTAAKC

SEQ ID NO: 1585 - protein, 13 aa, Unknown
  Description of Unknown: Anti-microbial peptide
QLSAMGLYQSLGF

SEQ ID NO: 1586 - protein, 17 aa, Unknown
  Description of Unknown: Anti-microbial peptide
ATKKNGRKLCLDLQAAL

SEQ ID NO: 1587 - protein, 17 aa, Unknown
  Description of Unknown: Anti-microbial peptide
  MOD_RES (4)..(4): Any amino acid
  MOD_RES (7)..(7): Any amino acid
  MOD_RES (10)..(10): Any amino acid
  MOD_RES (13)..(13): Any amino acid
WCFXVCXRGXCRXKCRR

SEQ ID NO: 1588 - protein, 13 aa, Unknown
  Description of Unknown: Anti-microbial peptide
ILKKFPFWPWRRK

SEQ ID NO: 1589 - protein, 69 aa, Unknown
  Description of Unknown: Anti-microbial peptide
MAELRCMCIKTTSGIHPKNIQSLEVIGKGTHCNQVEVIATLKDGRKICLDPDAPRIKKIVQKKLAGDES

SEQ ID NO: 1590 - protein, 16 aa, Unknown
  Description of Unknown: Anti-microbial peptide
  MOD_RES (16)..(16): Any amino acid
KWKGIGAVLKVLTTGX

SEQ ID NO: 1591 - protein, 26 aa, Unknown
  Description of Unknown: Anti-microbial peptide
KWKKFIKELQKVLKPGGLLSNIVTSL

SEQ ID NO: 1592 - protein, 14 aa, Unknown
  Description of Unknown: Anti-microbial peptide
IRRIIRKIIHIIKK

SEQ ID NO: 1593 - protein, 24 aa, Unknown
  Description of Unknown: Anti-microbial peptide
KKFAKKFAKKFAKKFAKKFAKKFA

SEQ ID NO: 1594 - protein, 25 aa, Unknown
  Description of Unknown: Anti-microbial peptide
FLIRQLIRLLTWLFSNCRTLLSEVY

SEQ ID NO: 1595 - protein, 12 aa, Unknown
  Description of Unknown: Anti-microbial peptide
KLCQRPSGTWSG

SEQ ID NO: 1596 - protein, 18 aa, Unknown
  Description of Unknown: Anti-microbial peptide
GICRCICGRRICRCICGR

SEQ ID NO: 1597 - protein, 100 aa, Unknown
  Description of Unknown: Anti-microbial peptide
MAKKAMVERDRKRKKLVEKYAAKREALKEQFAAATSQSERLELHRKLQQLPRNSAPNRVRNRCWVTGRPRGYYRDFGLCRNVLREMAHQGLLPGVVKSSW

SEQ ID NO: 1598 - protein, 100 aa, Unknown
  Description of Unknown: Anti-microbial peptide
MAKKSMIERDKRRSRLVAKYAAKREALKEEFRQAETLEDKLAVHQKLQDLPRNSAPNRRRNRCQVTGRPRSYYRDFGLCRNVLREWAHQGLLPGVTKSSW

SEQ ID NO: 1599 - protein, 60 aa, Unknown
  Description of Unknown: Anti-microbial peptide
ARKALIEKAKRTPKFKVRAYTRCVRCGRARSVYRFFGLCRICLRELAHKGQLPGVRKASW

SEQ ID NO: 1600 - protein, 88 aa, Unknown
  Description of Unknown: Anti-microbial peptide
ALTQERKREIIEQFKVHENDTGSPEVQIAILTEQINNLNEHLRVHKKDHHSRRGLLKMVGKRRRLLAYLRNKDVARYREIVEKLGLRR

SEQ ID NO: 1601 - protein, 88 aa, Unknown
  Description of Unknown: Anti-microbial peptide
AITQERKNQLINEFKTHESDTGSPEVQIAILTDSINNLNEHLRTHKKDHHSRRGLLKMVGKRRNLLTYLRNKDVTRYRELINKLGLRR

SEQ ID NO: 1602 - protein, 21 aa, Unknown
  Description of Unknown: Anti-microbial peptide
FLIRQLIRLLTWLFSNCRTLL

SEQ ID NO: 1603 - protein, 12 aa, Unknown
  Description of Unknown: Anti-microbial peptide
LCQRPSGTWSGV

SEQ ID NO: 1604 - protein, 90 aa, Unknown
  Description of Unknown: Anti-microbial peptide
MALDSAKKAEIVAKFAKKPGDTGSTEVQVALLTARIAELTEHLKIYKNDFSSRLGLLKLVGQRKRLLSYLKRKDYNSYSKLITELNLRDK

SEQ ID NO: 1605 - protein, 88 aa, Unknown [sequence omitted]

SEQ ID NO: 1606 - protein, 88 aa, Unknown
  Description of Unknown: Anti-microbial peptide
SLSTEKKAAIVAEFGRDAKDTGSSEVQIALLTAQINHLQTHFAEHKKDHHGRRGLLRMVSRRRKLLDYLKRTDLALYQSTIARLGLRR

SEQ ID NO: 1607 - protein, 90 aa, Unknown
  Description of Unknown: Anti-microbial peptide
MALNLEKKQEIIKAFATKENDTGSCEVQVALLNERIKLLTEHLKANPKDHSSRLGLLKLVAQRRNLLKYIKRTNHARYVVLIEKLGIKDR

SEQ ID NO: 1608 - protein, 88 aa, Unknown
  Description of Unknown: Anti-microbial peptide
MITKAKKAEIITRFGKSEKNTGDISVQIALLPEDIEKLKLHFEKNKKDKHSMRGFIAKVNKRKKLLNYLKEKNFASYKETIEALNIRK

SEQ ID NO: 1609 - protein, 86 aa, Unknown
  Description of Unknown: Anti-microbial peptide
MKIDKEQIIKAHQLHKNDVGSVQVQISILTDQIKKLTDHLLANKKDFISKRGLYTKVSKRKRLLKYLKERNIETYRDLIKNLNLRG

SEQ ID NO: 1610 - protein, 88 aa, Unknown
  Description of Unknown: Anti-microbial peptide
MISKARKQEIILKFGKNPKNTGNTSVQIALLTEDIERLKLHFLKNKKDKHSMRGFIAKVNKRKKLLNYLRINSFDTYKETIEALNIRK

SEQ ID NO: 1611 - protein, 89 aa, Unknown
  Description of Unknown: Anti-microbial peptide
MALTSEQKKEILSSYGLHATDTGSPEAQIALLTKRIADLTEHLKVHKHDHHSRRGLLLLVGRRRRLIKYLSLIDVQRYRSLIERLGLRR

SEQ ID NO: 1612 - protein, 21 aa, Unknown
  Description of Unknown: Anti-microbial peptide
LLTRCNSFLWTLLRILQRILF

SEQ ID NO: 1613 - protein, 86 aa, Unknown
  Description of Unknown: Anti-microbial peptide
MQIDKNGIIKSAQLHDKDVGSIQVQVSLLTSQIKQLTDHLLANKKDFISKRGLYAKVSKRKRLLKYLKHNDLEAYRNLVKTLNLRG

SEQ ID NO: 1614 - protein, 89 aa, Unknown
  Description of Unknown: Anti-microbial peptide
MALTAEQKKEILRSYGLHETDTGSPEAQIALLTKRIADLTEHLKVHKHDHHSRRGLLLLVGRRRRLIKYISQIDVERYRSLIERLGLRR

SEQ ID NO: 1615 - protein, 88 aa, Unknown
  Description of Unknown: Anti-microbial peptide
SLSTEAKAQIIAEFGRDANDSGSSEVQVALLTAQINHLQGHFSEHKKDHHSRRGLLRMVSQRRKLLDYLKRKNVTSYTALIGRLGLRR

SEQ ID NO: 1616 - protein, 89 aa, Unknown
  Description of Unknown: Anti-microbial peptide
MSLTQIRKQELMTEYQAHETDTGSADLQVAFLTERITQLTGHLKANPKDHASRRGLLKMIGRRKRLLSFINAREPERYQALIKRLGIRR

SEQ ID NO: 1617 - protein, 88 aa, Unknown
  Description of Unknown: Anti-microbial peptide
PITKEEKQKVIQEFARFPGDTGSTEVQVALLTLRINRLSEHLKVHKKDHHSHRGLLMMVGQRRRLLRYLQREDPERYRALIEKLGIRG

SEQ ID NO: 1618 - protein, 25 aa, Unknown
  Description of Unknown: Anti-microbial peptide
FLIRQLIRLLTWLFPNCRTLLSRVY

SEQ ID NO: 1619 - protein, 88 aa, Unknown
  Description of Unknown: Anti-microbial peptide
SLSVEAKAKIVADFGRDANDTGSSEVQVALLTAQINHLQGHFSEHKKDHHSRRGLLRMVSTRRKLLDYLKRKDVASYVSLIERLGLRR

SEQ ID NO: 1620 - protein, 89 aa, Unknown
  Description of Unknown: Anti-microbial peptide
AVKIRLKRMGAKKSPFYRIVVADSRSPRDGRFIETVGTYNPVAKPAEVKIDEELALKWLQTGAKPSDTVRNLFSSQGIMEKFHNAKQGK

SEQ ID NO: 1621 - protein, 82 aa, Unknown [sequence omitted]

SEQ ID NO: 1622 - protein, 82 aa, Unknown
  Description of Unknown: Anti-microbial peptide
MVTIRLSRGGAKKRPFYQIVVADSRSPRDGRFIERVGFFNPIAQGNAERLRINLERVNHWVAQGASLSDRVASLVKEAQKAA

SEQ ID NO: 1623 - protein, 76 aa, Unknown
  Description of Unknown: Anti-microbial peptide
MTVIRLTRIGRKKKPFYRVVVTDSRKRRDGGWIESIGYYNPLSEPKDIKIDKERLNYWKGVGAKMSERVEKLSQKA

SEQ ID NO: 1624 - protein, 25 aa, Unknown
  Description of Unknown: Anti-microbial peptide
YVRSLLTRCNSFLWTLLRILQRILF

SEQ ID NO: 1625 - protein, 89 aa, Unknown
  Description of Unknown: Anti-microbial peptide
MRMGRVHYPLYRIVAVDSRVKRNGKYIALIGHLNPALKENKCKLDETVALDWLNKGAIPTDTVRSLFSESGLWKKFIESKNKKETSPKK

SEQ ID NO: 1626 - protein, 88 aa, Unknown
  Description of Unknown: Anti-microbial peptide
MRMGRVHYPTYRIVAVDSRVKRDGKYIALIGHLNPALKENKCKIDEAVALEWLNKGAKPTDTVRSLFSQTGLWKKFVESKKKPVAKSK

SEQ ID NO: 1627 - protein, 82 aa, Unknown
  Description of Unknown: Anti-microbial peptide
MVTIRLARHGAKKRPFYQVVVTDSRNARNGRFIERVGFFNPIASEKEEGTRLDLDRIAHWVGQGATISDRVAALIKEVKKAA

SEQ ID NO: 1628 - protein, 82 aa, Unknown
  Description of Unknown: Anti-microbial peptide
MIKLRLKRFGKKREVSYRIVAMHSTTRRDGRPLEELGFYNPRTDETRLDVPAIVKRLKEGAQPTDTVRSILTKAQVFEQLKA

SEQ ID NO: 1629 - protein, 84 aa, Unknown
  Description of Unknown: Anti-microbial peptide
TDKIRSVQGRVVSDKMEKSFVVAIERKVKHPLYGKFIRRTTKLHVHDENNEAKLGDLVEVRECRPISKTKSWTLVRVVEKAVIA

SEQ ID NO: 1630 - protein, 25 aa, Unknown
  Description of Unknown: Anti-microbial peptide
FLIKQLIKLLTWLFSNCKTLLSKVY

SEQ ID NO: 1631 - protein, 84 aa, Unknown
  Description of Unknown: Anti-microbial peptide
MTDVIRTLQGRVVSHKMEKSIVVAIERTVKHPIYGKFIKRTTKLHVHDENNECGIGDVVEIRECRPLSKTKSWTLVRVVDKAIL

SEQ ID NO: 1632 - protein, 86 aa, Unknown
  Description of Unknown: Anti-microbial peptide
SERNQRKVYVGRVVSDKMDKTITVLVETYKKHPLYGKRVKYSKKYKAHDEHNEAKVGDIVKIMETRPLSATKRFRLVEIVEKAVVL

SEQ ID NO: 1633 - protein, 86 aa, Unknown
  Description of Unknown: Anti-microbial peptide
SERNQRKVYQGRVVSDKMDKTITVVVETYKKHTLYGKRVKYSKKFKAHDENNQAKIGDIVKIMETRPLSATKRFRLVEVVEEAVII

SEQ ID NO: 1634 - protein, 83 aa, Unknown
  Description of Unknown: Anti-microbial peptide
MASDVRGRRKTKIGVVVSSKMEKTVVVRVERVYSHPQYAKVVRDSSKYYAHNELDVKEGDTVRIQETRPLSKTKRWRVVGRVN

SEQ ID NO: 1635 - protein, 83 aa, Unknown
  Description of Unknown: Anti-microbial peptide
TDKIRTLQGRVVSDKMEKSIVVAIERFVKHPIYGKFIKRTTKLHVHDENNECGIGDVVEIRECRPLSKTKSWTLVRVVEKAVL

SEQ ID NO: 1636 - protein, 84 aa, Unknown
  Description of Unknown: Anti-microbial peptide
TDKIRSVQGKVVSDKMEKSFVVAIERKVKHPLYGKFIRRTTKLHVHDENNEAKVGDTVEIRECRPLSKTKSWTLVRVVEKAVIA

SEQ ID NO: 1637 - protein, 23 aa, Unknown
  Description of Unknown: Anti-microbial peptide
RLVERIRQLTASRQLIPQLIQYV

SEQ ID NO: 1638 - protein, 86 aa, Unknown
  Description of Unknown: Anti-microbial peptide
MNTKEPHKRLVQGKVISKFAEKSAVILVERKVVHEKYRKIVKKFKKYTIHDENNQVKVGDFVSAIECRPLSKTKSFTLKEILVVGV

SEQ ID NO: 1639 - protein, 85 aa, Unknown
  Description of Unknown: Anti-microbial peptide
MQRNSRRVLIGKVVSDKMDKTITVLVETYKNHPIYKKRVKYSKKYKAHDENQVAQMGDKVEIMETRPLSKTKNFRLVRVIEKATL

SEQ ID NO: 1640 - protein, 85 aa, Unknown
  Description of Unknown: Anti-microbial peptide
MKRNQRKQLIGTVVSTKNAKTATVKVTSRFKHPLYHKSVIRHKKYHVHNFGELVANDGDRVQIIETRPLSALKRWRIVKIIERAK

SEQ ID NO: 1641 - protein, 85 aa, Unknown
  Description of Unknown: Anti-microbial peptide
MKRNQRKVLIGIVKSTKNAKTATVQVESRFKHPLYHKSVVRHKKYQAHNEGEVLAKDGDKVQIVETRPLSATKRFRIAKIIERAK

SEQ ID NO: 1642 - protein, 23 aa, Unknown
  Description of Unknown: Anti-microbial peptide
RLVRRIRQLTASRQLIPQLIQYV

SEQ ID NO: 1643 - protein, 85 aa, Unknown
  Description of Unknown: Anti-microbial peptide
MERNSRKVLQGRVISDNLKKTITVLVETYKNHPLYKKRVKYSKKYLAHDEQNQAHIGDKVSIMETRPLSKTKHFRLIEVIEKAIG

SEQ ID NO: 1644 - protein, 82 aa, Unknown
  Description of Unknown: Anti-microbial peptide
MAVKERVGVVVSDKMDKTVVVAIEDRTAHPKYGKIVVRTKRYKAHDEDNRAKTGDRVRIQETRPLSRTKRWTVAEILESVGA

SEQ ID NO: 1645 - protein, 81 aa, Unknown
  Description of Unknown: Anti-microbial peptide
MAIKERVGIVVSNKMDKTVVVAVESRSPHPKYGKIVVKTKKFKAHDEENQCQEGDKVRIQETRPLSKTKRWQVINIMSHSS

SEQ ID NO: 1646 - protein, 77 aa, Unknown
  Description of Unknown: Anti-microbial peptide
AGRKGGRGKRRKVCYFTANNITHIDYKDVDLLKKFISERGKILPRRVTGTSAKYQRKLTVAIKRARQMALLPYVADE

SEQ ID NO: 1647 - protein, 78 aa, Unknown
  Description of Unknown: Anti-microbial peptide
AGGRRGGRAKRRKVCYFTSNGITHIDYKDVDLLKKFVSERGKILPRRVTGTNAKYQRKLTAAIKRARQMALLPYVSGE

SEQ ID NO: 1648 - protein, 27 aa, Unknown
  Description of Unknown: Anti-microbial peptide
LLSRVYQILQPILQRLSATLQAIREVL

SEQ ID NO: 1649 - protein, 77 aa, Unknown
  Description of Unknown: Anti-microbial peptide
MNRPVHNEHRRKRFAKKCPFVSAGWKTIDYKDVVTLKRFITERGKILPRRITGVSSRFQALLAQAVKRARHVGLLLS

SEQ ID NO: 1650 - protein, 74 aa, Unknown
  Description of Unknown: Anti-microbial peptide
ARYFRRRKFCRFTAEGVQEIDYKDIATLKNYITESGKIVPSRITGTRAKYQRQLARAIKRARYLSLLPYTDRHQ

SEQ ID NO: 1651 - protein, 74 aa, Unknown
  Description of Unknown: Anti-microbial peptide
ARYFRRRKFCRFTAENVVEIDYKDIATLKNYISESGKIVPSRITGTRAKYQRQLARAIKRARYLALLPYTDNHQ

SEQ ID NO: 1652 - protein, 85 aa, Unknown
  Description of Unknown: Anti-microbial peptide
MERKRYSKRYCKYTEAKISFIDYKDLDMLKHTLSERYKIMPRRLTGNSKKWQERVEVAIKRARHMALIPYIVDRKKVVDSPFKQH

SEQ ID NO: 1653 - protein, 28 aa, Unknown
  Description of Unknown: Anti-microbial peptide
LLSRVYQILQPILQRLCATLQRIREVLR

SEQ ID NO: 1654 - protein, 84 aa, Unknown
  Description of Unknown: Anti-microbial peptide
MAKSSKRRPAPEKPVKTRKCVFCAKKDQAIDYKDTALLRTYISERGKIRARRVTGNCVQHQRDIALAVKNAREVALLPFTSSVR

SEQ ID NO: 1655 - protein, 76 aa, Unknown
  Description of Unknown: Anti-microbial peptide
MARQSFKRRKFCRFTAEKIQEVDYKQVDLLKDFISENGKIIPARITGTKAFYQRQLAVAVKRARFLALLPYTDQHK

SEQ ID NO: 1656 - protein, 71 aa, Unknown
  Description of Unknown: Anti-microbial peptide
MNYYRKRLSPLPPNQPIDYKDTELLRKFITERGKILPRRITGLTAKQQRDLTTAVKRSRLVALLPFVNKEI

SEQ ID NO: 1657 - protein, 91 aa, Unknown
  Description of Unknown: Anti-microbial peptide
GRSLKKGPFCDEHLMKKIEKLNETGQKQVIKTWSRRSTIFPQFVGHTIAVYDGRRHVPVYITEDMVGHKLGEFAPTATFRGHAGDDKKTKR

SEQ ID NO: 1658 - protein, 91 aa, Unknown
  Description of Unknown: Anti-microbial peptide
ARSLKKGPFVDGHLMTKIEKLNETDKKQVVKTWSRRSTIFPQFIGHTIAVYDGRKHVPVFISEDMVGHKLGEFAPTRTYKGHASDDKKTRR

SEQ ID NO: 1659 - protein, 92 aa, Unknown
  Description of Unknown: Anti-microbial peptide
MARSIKKGPFIEKSLYQKVLSSFGSEKRVVIKTYSRSSTIIPEMVSLTISVYNAKTFIPIYITEDLVGHKLGEFSPTRIFRGHAKSDKKGRK

SEQ ID NO: 1660 - protein, 91 aa, Unknown
  Description of Unknown: Anti-microbial peptide
PRSLKKGPFIDLHLLKKVEKAVESGDKKPLRTWSRRSTIFPNMIGLTIAVHNGRQHVPVFVTDEMVGHKLGEFAPTRTYRGHAADKKAKKK

SEQ ID NO: 1661 - protein, 21 aa, Unknown
  Description of Unknown: Anti-microbial peptide
LAKLAVKAIKGAIAGAKSAMG

SEQ ID NO: 1662 - protein, 23 aa, Unknown
  Description of Unknown: Anti-microbial peptide
AIANFERLMKKLIWALMGEAVQT

SEQ ID NO: 1663 - protein, 13 aa, Unknown
  Description of Unknown: Anti-microbial peptide
TLPCLWPWWPWSI

SEQ ID NO: 1664 - protein, 18 aa, Unknown
  Description of Unknown: Anti-microbial peptide
KNLRRIARKIIHIIKKYG

SEQ ID NO: 1665 - protein, 9 aa, Unknown
  Description of Unknown: Anti-microbial peptide
AHKCICYFP

SEQ ID NO: 1666 - protein, 14 aa, Unknown
  Description of Unknown: Anti-microbial peptide
KRLFKELKFSLRKY

SEQ ID NO: 1667 - protein, 7 aa, Unknown
  Description of Unknown: Anti-microbial peptide
  MOD_RES (2)..(2): Any amino acid
  MOD_RES (4)..(4): Any amino acid
  MOD_RES (6)..(6): Any amino acid
PXPXPXP

SEQ ID NO: 1668 - protein, 79 aa, Unknown
  Description of Unknown: Anti-microbial peptide
MAKFATIISLLFAALVLFAAFEAPTMVDARLCERPSGTWSGVCGNNNACRNQCRNLERAEHGSCNYVFPAHKCICYFPC

SEQ ID NO: 1669 - protein, 25 aa, Unknown
  Description of Unknown: Anti-microbial peptide
NQGRHFSGGALIHARFVMTAAHCFQ

SEQ ID NO: 1670 - protein, 8 aa, Unknown
  Description of Unknown: Anti-microbial peptide
RFEKSKIK

SEQ ID NO: 1671 - protein, 18 aa, Unknown
  Description of Unknown: Anti-microbial peptide
  MOD_RES (1)..(1): Any amino acid
  MOD_RES (10)..(10): Any amino acid
  MOD_RES (12)..(12): Any amino acid
  MOD_RES (14)..(16): Any amino acid
XRWCFRVCYXGXCXXXCR

SEQ ID NO: 1672 - protein, 12 aa, Unknown
  Description of Unknown: Anti-microbial peptide
ILRYVYYVYRRK

SEQ ID NO: 1673 - protein, 84 aa, Unknown
  Description of Unknown: Anti-microbial peptide
MNLAKGKEESLDSDLYAELRCMCIKTTSGIHPKNIQSLEVIGKGTHCNQVEVIATLKDGRKICLDPDAPRIKKIVQKKLAGDES

SEQ ID NO: 1674 - protein, 20 aa, Unknown
  Description of Unknown: Anti-microbial peptide
KKWWRRVLSGLKTGPALSNV

SEQ ID NO: 1675 - protein, 13 aa, Unknown
  Description of Unknown: Anti-microbial peptide
LRRIIRKIIHIIK

SEQ ID NO: 1676 - protein, 14 aa, Unknown
  Description of Unknown: Anti-microbial peptide
VKLKVYPLKVKLYP

SEQ ID NO: 1677 - protein, 20 aa, Unknown
  Description of Unknown: Anti-microbial peptide
LKKLLKKLLKKLLKKLLKKL

SEQ ID NO: 1678 - protein, 76 aa, Unknown
  Description of Unknown: Anti-microbial peptide
MRTFALLTAMLLLVALHAQAEARQARADEAAAQQQPGTDDQGMAHSFTWPENAALPLSESAKGLRCICTRGFCRLL

SEQ ID NO: 1679 - protein, 28 aa, Unknown
  Description of Unknown: Anti-microbial peptide
RLVERIRQLTASLRQLIPQLIQYVRSLL

SEQ ID NO: 1680 - protein, 90 aa, Unknown
  Description of Unknown: Anti-microbial peptide
PRSLKKGPFLDLHLLKKVEKAVESGDKKPIKTWSRRSMIIPSMIGLTIAVHNGRQHVPVYVSDEMIGHKLGEFAPTRTYRGHAADKKAKK

SEQ ID NO: 1681 - protein, 93 aa, Unknown
  Description of Unknown: Anti-microbial peptide
MSRSIKKGPFIDDHLMKKTLKAKEGKDNRPIKTWSRRSTILPEMIGFTYNVHNGRVFIPVYITENHVGYKLGEFAPTRTFKGHKGSVQKKIGK

SEQ ID NO: 1682 - protein, 93 aa, Unknown
  Description of Unknown: Anti-microbial peptide
MPRSLKKGPFVDEHLLKKVDVQNEKNTKQVIKTWSRRSTIIPDFIGHTFAVHDGRKHVPVFVTESMVGHKLGEFAPTRRFKGHIKDDRKSKRR

SEQ ID NO: 1683 - protein, 88 aa, Unknown
  Description of Unknown: Anti-microbial peptide
MARSLKKGPFVDENLFKKVTSAKDGEVIKTWSRRSTIFPEFIGKTFGVYNGKEFIPVYITEDMVGNKLGEFAPTRKFGGHGDDKGKKK

SEQ ID NO: 1684 - protein, 87 aa, Unknown
  Description of Unknown: Anti-microbial peptide
MSRSSKKGAFVDAHLLKKVIEMNKQAKKKPIKTWSRRSTIFPEFVGNTFSVHNGKTFINVYVTDDMVGHKLGEFSPTRNFKQHTANR

SEQ ID NO: 1685 - protein, 28 aa, Unknown
  Description of Unknown: Anti-microbial peptide
LLSKVYQILQPILQKLSATLQKIKEVLK

SEQ ID NO: 1686 - protein, 93 aa, Unknown
  Description of Unknown: Anti-microbial peptide
MPRSLKKGPFVDDHLLKKVDVQNEKNTKQVIKTWSRRSTIIPDFIGHTFAVHDGRKHVPVFVTEAMVGHKLGEFAPTRTFKGHIKDDRKAKRR

SEQ ID NO: 1687 - protein, 87 aa, Unknown
  Description of Unknown: Anti-microbial peptide
MSRSAKKGAFVDAHLLKKVIDMNKQEKKRPIKTWSRRSTIFPEFVGNTFAVHNGKTFINVYVTDDMVGHKLGEFSPTRNFKQHTANR

SEQ ID NO: 1688 - protein, 91 aa, Unknown
  Description of Unknown: Anti-microbial peptide
MARSLKKGPFVADHLLRKVEKLNAKGDKQVIKTWSRASTILPQMIGHTIAVHNGRQHVPVYVTEQMVGHKLGEFAPTRTFRGHTKDKKAGR

SEQ ID NO: 1689 - protein, 92 aa, Unknown
  Description of Unknown: Anti-microbial peptide
MGRSLKKGPFVAASLLRKIDKLNDKGDKQVVKTWSRASTILPQMVGHTIAVHNGRQHVPVFVSEQMVGHKLGEFAPTRTFRSHSKSDKKARK

SEQ ID NO: 1690 - protein, 95 aa, Unknown
  Description of Unknown: Anti-microbial peptide
MGRSRKKGPYVDRKLLEKIRKLNETGEKKVIKTWSRASMIIPKWVGHGIAVYNGMKHIPVYITENMIGHRLGEFAPTRRFGGHADKKAKKGELKK

SEQ ID NO: 1691 - protein, 25 aa, Unknown
  Description of Unknown: Anti-microbial peptide
RLLTWLFSNCRTLLSRVYQILQPIL

SEQ ID NO: 1692 - protein, 87 aa, Unknown
  Description of Unknown: Anti-microbial peptide
PNIKSAIKRTKTNNERGVHNATIKSAMRTAIKQVEASVANNEADKAKTALTEAAKRIDKAVKTGLVHKNTAARYKSRLAKKVNGLSA

SEQ ID NO: 1693 - protein, 85 aa, Unknown
  Description of Unknown: Anti-microbial peptide
MRKNASALKRSRQNLKRKIRNVSVKSELKTIEKRCINMIKAGKKDEAIEFFKFVAKKLDTAARKRIIHKNKAARKKSRLNVLLLK

SEQ ID NO: 1694 - protein, 86 aa, Unknown [sequence omitted]

SEQ ID NO: 1695 - protein, 25 aa, Unknown
  Description of Unknown: Anti-microbial peptide
RLLTWLFSNRRTLLSRVYQILQEIL

SEQ ID NO: 1696 - protein, 86 aa, Unknown
  Description of Unknown: Anti-microbial peptide
ANIKSAKKRAVQSEKRRQHNASQRSMMRTYIKKVYAQVAAGEKSAAEAAFVEMQKVVDRMASKGLIHANKAANHKSKLAAQIKKLA

SEQ ID NO: 1697 - protein, 89 aa, Unknown
  Description of Unknown: Anti-microbial peptide
MANHKSAEKRIRQTIKRTERNRFYKTKIKNIIKAVREAVAVNDVAKAQERLKIANKELHKFVSKGILKKNTASRKVSRLNASVKKIALA

SEQ ID NO: 1698 - protein, 88 aa, Unknown
  Description of Unknown: Anti-microbial peptide
MANIKSNEKRLRQDIKRNLNNKGQKTKLKTNVKKFNKEINLDNLSSVYSQADRLARKGIISLNRAKRLKSKNAVILHKSNTNSTAKKQ

SEQ ID NO: 1699 - protein, 86 aa, Unknown
  Description of Unknown: Anti-microbial peptide
MTNIKSQQKRNRTNERARLRNKSVKSSLRTAVRAFREAVHAGEKEKAAKLLVSTSRKLDKAASKGVIHKNQAANKKSALARTLNKL

SEQ ID NO: 1700 - protein, 87 aa, Unknown
  Description of Unknown: Anti-microbial peptide
MANIKSNEKRLRQNIKRNLNNKGQKTKLKTNVKNFHKEINLDNLGNVYSQADRLARKGIISTNRARRLKSRNVAVLNKTQVTAVEGK

SEQ ID NO: 1701 - protein, 88 aa, Unknown
  Description of Unknown: Anti-microbial peptide
MANTTSAKKATRKIARRSAVNKARRSRIRSFVRKVEEAIASGDQALAAAALKAAQPELMRPATKGVMHSNTASRKVSRLAQRVKSLSA

SEQ ID NO: 1702 - protein, 97 aa, Unknown
  Description of Unknown: Anti-microbial peptide
MANIKSALKRIEIAERNRLQNKSYKSAIKTLMKKTFQSVEAYASDPNPEKLDTINTSMAAAFSKIDKAVKCKVIHKNNAARKKARLAKALQSALPAA

SEQ ID NO: 1703 - protein, 22 aa, Unknown
  Description of Unknown: Anti-microbial peptide
RLLTWLRRTLLSRVYQILQEIL

SEQ ID NO: 1704 - protein, 62 aa, Unknown
  Description of Unknown: Anti-microbial peptide
MTQIVVGENEHIESALRRFKREVSKAGIFQDMRKHRHFETPIEKSKRKKLALHKQSKRRFRT

SEQ ID NO: 1705 - protein, 55 aa, Unknown
  Description of Unknown: Anti-microbial peptide
SKTIVRKNESIDDALRRFKRAVSKTGTLQEVRKREFYEKPSVRRKKKSEAARKRK

SEQ ID NO: 1706 - protein, 56 aa, Unknown
  Description of Unknown: Anti-microbial peptide
SKTVVRKNESLEDALRRFKRSVSKTGTLQEARKREFYEKPSVKRKKKSEAARKRKF

SEQ ID NO: 1707 - protein, 70 aa, Unknown
  Description of Unknown: Anti-microbial peptide
MTTILLKENEPFEVAIRRFRRAIEKNGLIAELRERQAYEKPTAVRKRKKAAAVKRLHKRLRSQMLPKKLH

SEQ ID NO: 1708 - protein, 88 aa, Unknown
  Description of Unknown: Anti-microbial peptide
MQNDAGQTVELYVPRKCSSSNRIIGPKDHASVQIDFVDVDPETGRMIPGKSTRYAICGAIRRMGESDDAILRLAQKDGLVPRDDVKSN

SEQ ID NO: 1709 - protein, 70 aa, Unknown
  Description of Unknown: Anti-microbial peptide
PVIKVRENEPFDVALRRFKRSCEKAGVLAEVRRREFYEKPTTERKRAKASAVKRHAKKLARENARRTRLY

SEQ ID NO: 1710 - protein, 70 aa, Unknown
  Description of Unknown: Anti-microbial peptide
PVIKVRENESFDVALRRFKRSCEKAGILAEVRAREFYEKPTTIRKRENATLAKRHAKRNARENARNTRLY

SEQ ID NO: 1711 - protein, 70 aa, Unknown
  Description of Unknown: Anti-microbial peptide
MPGIKVREGDAFDEAYRRFKKQTDRNLVVTECRARRFFESKTEKRKKQKISAKKKVLKRLYMLRRYESRL

SEQ ID NO: 1712 - protein, 83 aa, Unknown
  Description of Unknown: Anti-microbial peptide
MQNDAGEFVDLYVPRKCSASNRIIGAKDHASIQMNVAEVDKVTGRFNGQFKTYAICGAIRRMGESDDSILRLAKADGIVSKNF

SEQ ID NO: 1713 - protein, 81 aa, Unknown
  Description of Unknown: Anti-microbial peptide
MQNEEGKTVDLYVPRKCSATNRIITAKDHASVQINIGHLDANGLYDGHFTTFALSGFVRAQGDADSSLDRLWQKKKAEIKQ

SEQ ID NO: 1714 - protein, 29 aa, Unknown
  Description of Unknown: Anti-microbial peptide
RIAGYGLRGLAVIIRCIIRGLNLIFEIIR

SEQ ID NO: 1715 - protein, 64 aa, Unknown
  Description of Unknown: Anti-microbial peptide
MPGIRVKEGESIESALKRFKKATEKAGILSEIRKREHYEKPSVKRKKKALAAKKRAVKKARKSF

SEQ ID NO: 1716 - protein, 82 aa, Unknown
  Description of Unknown: Anti-microbial peptide
MQNEEGQMVDLYVPRKCSATNRIITAKDHASVQINIGHVDENGLYDGRFTTFALSGFIRAQGDADSALDRLWQKRKAEVKQQ

SEQ ID NO: 1717 - protein, 83 aa, Unknown
  Description of Unknown: Anti-microbial peptide
MQNDAGEFVDLYVPRKCSASNRIIAAKDHASIQMNVAEVDRSTGRFNGQFKTYGICGAIRRMGESDDSILRLAKADGIVSKNF

SEQ ID NO: 1718 - protein, 60 aa, Unknown
  Description of Unknown: Anti-microbial peptide
MTQVVVGQNEPIESALRRFKRQVAKAGIYTDFKKHQFFETPQEKHKRKEATRRRQRSRRR

SEQ ID NO: 1719 - protein, 45 aa, Unknown
  Description of Unknown: Anti-microbial peptide
MKSNRQARHILGLDHKISNQRKIVTEGDKSSVVNNPTGRKRPAEK

SEQ ID NO: 1720 - protein, 129 aa, Unknown
  Description of Unknown: Anti-microbial peptide
TRSSVLADALNAINNAEKTGKRQVLIRPSSKVIIKFLQVMQKHGYIGEFEYIDDHRSGKIVVQLNGRLNKCGVISPRFNVKIGDIEKWTANLLPARQFGYVILTTSAGIMDHEEARRKHVSGKILGFVY

SEQ ID NO: 1721 - protein, 29 aa, Unknown
  Description of Unknown: Anti-microbial peptide
RIAGYGLRGLAVIIRIICRGLNLIFEIIR

SEQ ID NO: 1722 - protein, 30 aa, Unknown
  Description of Unknown: Anti-microbial peptide
RIAGYGLRGLAVIPRRICIRGLNLIFEIIR

SEQ ID NO: 1723 - protein, 29 aa, Unknown
  Description of Unknown: Anti-microbial peptide
RIIEFILNLGRICIRIIVALGRLGYGAIR

SEQ ID NO: 1724 - protein, 86 aa, Unknown
  Description of Unknown: Anti-microbial peptide
MVLSSDIDLLNPPAELEKTKHKRKRLVQSPNSFFMDVKCQGCFNITTVFSHSQTVVMCGSCSSVLCTPTGWPRRLTEGCSFRRKSD

SEQ ID NO: 1725 - protein, 84 aa, Unknown
  Description of Unknown: Anti-microbial peptide
MPLIEVDLLNPTAASEAKAHKMKRLVPTPNSYFLEIKCPKCGATTTTFSHAHRQILCQKCGQPLGQPTGGKLKLTQQCKFRIKK

SEQ ID NO: 1726 - protein, 62 aa, Unknown
  Description of Unknown: Anti-microbial peptide
MMELIPQPRTKFLRVQCPECNNEQIVFGSPATVVKCLTCGKVLVEPRGGKGKVKAKILEILG

SEQ ID NO: 1727 - protein, 64 aa, Unknown [sequence omitted]

SEQ ID NO: 1728 - protein, 69 aa, Unknown [sequence omitted]

SEQ ID NO: 1729 - protein, 29 aa, Unknown
  Description of Unknown: Anti-microbial peptide
KIAGYGLKGLAVIIKICIKGLNLIFEIIK

SEQ ID NO: 1730 - protein, 65 aa, Unknown
  Description of Unknown: Anti-microbial peptide
MDTQVKLAVVVKVMGRTGSRGQVTQVRVKFLDDQNRLIMRNVKGPVCEGDILTLLESEREARRLR

SEQ ID NO: 1731 - protein, 78 aa, Unknown
  Description of Unknown: Anti-microbial peptide
MMRMEDEFVYKEAVAAEVIEVIGRTGVTGGIIQVRCKILGGKDTGRVLVRNVKGPVKVGDIIMLRETEREARPLDRRR

SEQ ID NO: 1732 - protein, 68 aa, Unknown
  Description of Unknown: Anti-microbial peptide
MDSSKVPVKLAKVIKVLGRTGSRGGVTQVRVEFMDDTSRSIIRNVKGPVREDDILVLLESEREARRLR

SEQ ID NO: 1733 - protein, 55 aa, Unknown
  Description of Unknown: Anti-microbial peptide
GHQQLYWSHPRKFGQGSRSCRVCSNRHGLIRKYGLNMCRQCFRQYAKDIGFIKLD

SEQ ID NO: 1734 - protein, 60 aa, Unknown
  Description of Unknown: Anti-microbial peptide
KVHGSLARAGKVRGRHQKVAKQDKKKKPRGRAHKRLQHNRRFVTAVVGFGKKRGPNSSEK

SEQ ID NO: 1735 - protein, 62 aa, Unknown
  Description of Unknown: Anti-microbial peptide
AKVHGSLARAGKVKSQTPKVEKTEKPKKPKGRAYKRLLYTRRFVNVTLVNGKRRMNPGPSVQ

SEQ ID NO: 1736 - protein, 67 aa, Unknown
  Description of Unknown: Anti-microbial peptide
MDTKTPVTLAKVIKVLGRTGSRGGVTQVRVEFLEDTTRTIVRNVKGPVREGDILVLMESEREARRLR

SEQ ID NO: 1737 - protein, 12 aa, Unknown
  Description of Unknown: Anti-microbial peptide
RNSLPKVAYATA

SEQ ID NO: 1738 - protein, 14 aa, Unknown
  Description of Unknown: Anti-microbial peptide
KLKKALRALARHWK

SEQ ID NO: 1739 - protein, 20 aa, Unknown
  Description of Unknown: Anti-microbial peptide
IIGGRESRPHSRPYMAYLQI

SEQ ID NO: 1740 - protein, 9 aa, Unknown
  Description of Unknown: Anti-microbial peptide
HKCICYFPC

SEQ ID NO: 1741 - protein, 14 aa, Unknown
  Description of Unknown: Anti-microbial peptide
KRLFKKLKFSLRKY

SEQ ID NO: 1742 - protein, 23 aa, Unknown
  Description of Unknown: Anti-microbial peptide
  MOD_RES (2)..(3): Any amino acid
  MOD_RES (5)..(14): Any amino acid
  MOD_RES (17)..(21): Any amino acid
CXXCXXXXXXXXXXCCXXXXXCC

SEQ ID NO: 1743 - protein, 25 aa, Unknown
  Description of Unknown: Anti-microbial peptide
NQGRHFSGGALIHARFVMTAARCFQ

SEQ ID NO: 1744 - protein, 20 aa, Unknown
  Description of Unknown: Anti-microbial peptide
SAIHPSSILKLEVICIGVLQ

SEQ ID NO: 1745 - protein, 19 aa, Unknown
  Description of Unknown: Anti-microbial peptide
  MOD_RES (6)..(6): Any amino acid
  MOD_RES (9)..(9): Any amino acid
  MOD_RES (12)..(12): Any amino acid
  MOD_RES (15)..(16): Any amino acid
  MOD_RES (19)..(19): Any amino acid
RRWCFXVCXRGXCYXXCRX

SEQ ID NO: 1746 - protein, 26 aa, Unknown
  Description of Unknown: Anti-microbial peptide
KGWGSFFKKAAHVGKHVGKAALTHYL

SEQ ID NO: 1747 - protein, 15 aa, Unknown
  Description of Unknown: Anti-microbial peptide
ILRWPWWPWWPWRRK

SEQ ID NO: 1748 - protein, 91 aa, Unknown
  Description of Unknown: Anti-microbial peptide
MGHHHHHHHHHHSSGHIEGRHMYLRCMCIKTTSGIHPKNIQSLEVIGKGTHCNQVEVIATLKDGRKICLDPDAPRIKKIVQKKLAGDESAD

SEQ ID NO: 1749 - protein, 20 aa, Unknown
  Description of Unknown: Anti-microbial peptide
KKWWRRVLKGLSSGPALSNV

SEQ ID NO: 1750 - protein, 13 aa, Unknown
  Description of Unknown: Anti-microbial peptide
RRIIRKIIHIIKK

SEQ ID NO: 1751 - protein, 24 aa, Unknown
  Description of Unknown: Anti-microbial peptide
LKKLLKKLLKKLLKKLLKKLLKKL

SEQ ID NO: 1752 - protein, 28 aa, Unknown
  Description of Unknown: Anti-microbial peptide
RVIRVVQGACRAIRHIPRRIRQGLRRIL

SEQ ID NO: 1753 - protein, 67 aa, Unknown
  Description of Unknown: Anti-microbial peptide
MDSKTPVTLAKVIKVLGRTGSRGGVTQVRVEFLEDTTRTIVRNVKGPVREGDILVLMESEREARRLR

SEQ ID NO: 1754 - protein, 67 aa, Unknown
  Description of Unknown: Anti-microbial peptide
MDSKTPVTLAKVIKVLGRTGSRGGVTQVRVEFLEDTSRTIVRNVKGPVRENDILVLMESEREARRLR

SEQ ID NO: 1755 - protein, 76 aa, Unknown
  Description of Unknown: Anti-microbial peptide
GKKRKKKVYTTPKKIKHKHKKVKLAVLSYYKVDAEGKVTKLRRECSNPTCGAGVFLANHKDRLYCGKCHSVYKVNA

SEQ ID NO: 1756 - protein, 28 aa, Unknown
  Description of Unknown: Anti-microbial peptide
RVIEVVQGACRAIEHIPRRIEQGLERIL

SEQ ID NO: 1757 - protein, 28 aa, Unknown
  Description of Unknown: Anti-microbial peptide
RVIEVVQGACRAIEHIPRRIRQGLERIL

SEQ ID NO: 1758 - protein, 28 aa, Unknown
  Description of Unknown: Anti-microbial peptide
RVIEVVQGACRAIRHIPRRIEQGLERIL

SEQ ID NO: 1759 - protein, 28 aa, Unknown
  Description of Unknown: Anti-microbial peptide
RVIEVVQGACRASRHIPRRIRQGLERIL

SEQ ID NO: 1760 - protein, 28 aa, Unknown
  Description of Unknown: Anti-microbial peptide
RVIEVVQGACRAIRHIPRRSRQGLERIL

SEQ ID NO: 1761 - protein, 25 aa, Unknown
  Description of Unknown: Anti-microbial peptide
FLIRQLIELLTWLFSNCRTLLSEVY

SEQ ID NO: 1762 - protein, 28 aa, Unknown
  Description of Unknown: Anti-microbial peptide
LLSEVYQILQPILQELSATLQRIREVLR

SEQ ID NO: 1763 - protein, 21 aa, Unknown
  Description of Unknown: Anti-microbial peptide
YHELRDLLLIVTRIVELLGRE

SEQ ID NO: 1764 - protein, 26 aa, Unknown
  Description of Unknown: Anti-microbial peptide
GKGDRRTRRGKIWRGTYGKYRPRKKK

SEQ ID NO: 1765 - protein, 28 aa, Unknown
  Description of Unknown: Anti-microbial peptide
RVIEVVQGAYRAIRHIPRRIRQGLERIL

SEQ ID NO: 1766 - protein, 21 aa, Unknown
  Description of Unknown: Anti-microbial peptide
RQIIVFMRKKNFVTKILKKQR

SEQ ID NO: 1767 - protein, 23 aa, Unknown
  Description of Unknown: Anti-microbial peptide
IQRVAQKLKKALRALARHWKRAL

SEQ ID NO: 1768 - protein, 28 aa, Unknown
  Description of Unknown: Anti-microbial peptide
RVISVVQGACRAIRRIPRRIRQGLERIL

SEQ ID NO: 1769 - protein, 20 aa, Unknown
  Description of Unknown: Anti-microbial peptide
QSPAGQSRCGGFLVREDFVL

SEQ ID NO: 1770 - protein, 11 aa, Unknown
  Description of Unknown: Anti-microbial peptide
QIGTCFGRPVK

SEQ ID NO: 1771 - protein, 13 aa, Unknown
  Description of Unknown: Anti-microbial peptide
ILKKWPWWPWKRR

SEQ ID NO: 1772 - protein, 11 aa, Unknown
  Description of Unknown: Anti-microbial peptide
QIGTCFGRPVL

SEQ ID NO: 1773 - protein, 12 aa, Unknown
  Description of Unknown: Anti-microbial peptide
CIRLEKARHGSC

SEQ ID NO: 1774 - protein, 24 aa, Unknown
  Description of Unknown: Anti-microbial peptide
DSHAKRHHGYKRKFHEKHHSHRGY

SEQ ID NO: 1775 - protein, 13 aa, Unknown
  Description of Unknown: Anti-microbial peptide
  MOD_RES (2)..(2): Any amino acid
  MOD_RES (4)..(4): Any amino acid
  MOD_RES (6)..(6): Any amino acid
  MOD_RES (8)..(10): Any amino acid
  MOD_RES (12)..(13): Any amino acid
PXPXPXPXXXPXX

SEQ ID NO: 1776 - protein, 25 aa, Unknown
  Description of Unknown: Anti-microbial peptide
NQGRHFSGGALIHARFVMTAAKCFQ

SEQ ID NO: 1777 - protein, 14 aa, Unknown
  Description of Unknown: Anti-microbial peptide
YAERLCTCSIKAEV

SEQ ID NO: 1778 - protein, 18 aa, Unknown
  Description of Unknown: Anti-microbial peptide
  MOD_RES (2)..(2): Any amino acid
  MOD_RES (5)..(7): Any amino acid
  MOD_RES (14)..(16): Any amino acid
RXWCXXXCYRGFCXXXCR

SEQ ID NO: 1779 - protein, 26 aa, Unknown
  Description of Unknown: Anti-microbial peptide
ALWKTMLKKAAHVGKHVGKAALTHYL

SEQ ID NO: 1780 - protein, 12 aa, Unknown
  Description of Unknown: Anti-microbial peptide
WWRWPWWPWRRK

SEQ ID NO: 1781 - protein, 93 aa, Unknown
  Description of Unknown: Anti-microbial peptide
MGHHHHHHHHHHSSGHIEGRHMYAELRCMCIKTTSGIHPKNIQSLEVIGKGTHCNQVEVIATLKDGRKICLDPDAPRIKKIVQKKLAGDESAI

SEQ ID NO: 1782 - protein, 20 aa, Unknown
  Description of Unknown: Anti-microbial peptide
KKWWRRALQALKNGPALSNV

SEQ ID NO: 1783 - protein, 12 aa, Unknown
  Description of Unknown: Anti-microbial peptide
RRIIRKIIHIIK

SEQ ID NO: 1784 - protein, 10 aa, Unknown
  Description of Unknown: Anti-microbial peptide
  MOD_RES (1)..(1): Any amino acid
  MOD_RES (3)..(5): Any amino acid
  MOD_RES (7)..(9): Any amino acid
XTXXXFXXXT

SEQ ID NO: 1785 - protein, 28 aa, Unknown
  Description of Unknown: Anti-microbial peptide
LKKLLKKLLKKLLKKLLKKLLKKLLKKL

SEQ ID NO: 1786 - protein, 76 aa, Unknown
  Description of Unknown: Anti-microbial peptide
MRTFALLTAMLLLVALHAQAEARQARADEAAAQQQPGADDQGMAHSFTRPENAALPLSESARGLRCLCRRGVCQLL

SEQ ID NO: 1787 - protein, 78 aa, Unknown
  Description of Unknown: Anti-microbial peptide
MRSVWKGCFYKNNNNGLSKSSTVINTMLKKKFTLHDGKSYKSILIDRSMVGLKIGEFVFTRKMGVLHKKKVLKKKGKK

SEQ ID NO: 1788 - protein, 83 aa, Unknown
  Description of Unknown: Anti-microbial peptide
MSRAIWKGPFIDPFFFRKNGSSNSNNKIYSRRSVVSPKFIGREVEIYNGHKWITIKIKEDMIGHKFGEFAFTRKATIHKKKTK

SEQ ID NO: 1789 - protein, 78 aa, Unknown
  Description of Unknown: Anti-microbial peptide
MARSLSKPPFCEVKLATNNSVTKIWSRRSAILPQFVGKTVSIHNGRIFIPCKISPEMIGHKFGEFAVTRKKPIHKKKK

SEQ ID NO: 1790 - protein, 6 aa, Unknown
  Description of Unknown: Anti-microbial peptide
AKSRWY

SEQ ID NO: 1791 - protein, 26 aa, Unknown
  Description of Unknown: Anti-microbial peptide
IRALQRAVRHPRAIRRIYRGWKKAIR

SEQ ID NO: 1792 - protein, 28 aa, Unknown
  Description of Unknown: Anti-microbial peptide
RVIEVVQGACRAIRHIPRRIRQILERIL

SEQ ID NO: 1793 - protein, 20 aa, Unknown
  Description of Unknown: Anti-microbial peptide
TAAHCWGSNINVTLGAHNIQ

SEQ ID NO: 1794 - protein, 14 aa, Unknown
  Description of Unknown: Anti-microbial peptide
ILKKWPWWPWKWKK

SEQ ID NO: 1795 - protein, 9 aa, Unknown
  Description of Unknown: Anti-microbial peptide
NGGVCIPIR

SEQ ID NO: 1796 - protein, 18 aa, Unknown
  Description of Unknown: Anti-microbial peptide
KNLRRIIRKTIHIIKKYG

SEQ ID NO: 1797 - protein, 12 aa, Unknown
  Description of Unknown: Anti-microbial peptide
EKARHGSCNYVF

SEQ ID NO: 1798 - protein, 14 aa, Unknown
  Description of Unknown: Anti-microbial peptide
KRKFHEKHHSHRGY

SEQ ID NO: 1799 - protein, 19 aa, Unknown
  Description of Unknown: Anti-microbial peptide
  MOD_RES (2)..(2): Any amino acid
  MOD_RES (4)..(4): Any amino acid
  MOD_RES (6)..(6): Any amino acid
  MOD_RES (8)..(10): Any amino acid
  MOD_RES (12)..(12): Any amino acid
  MOD_RES (14)..(15): Any amino acid
  MOD_RES (17)..(18): Any amino acid
PXPXPXPXXXPXPXXPXXP

SEQ ID NO: 1800 - protein, 25 aa, Unknown
  Description of Unknown: Anti-microbial peptide
NQGRHFCGGALIHARFVMTAAHSFQ

SEQ ID NO: 1801 - protein, 11 aa, Unknown
  Description of Unknown: Anti-microbial peptide
KFKHYFFWKYK

SEQ ID NO: 1802 - protein, 18 aa, Unknown
  Description of Unknown: Anti-microbial peptide
  MOD_RES (5)..(5): Any amino acid
  MOD_RES (10)..(10): Any amino acid
RRWCXRVCYXGFCYRKCR

SEQ ID NO: 1803 - protein, 25 aa, Unknown
  Description of Unknown: Anti-microbial peptide
SIGSAFKKAAHVGKHVGKAALTHYL

SEQ ID NO: 1804 - protein, 13 aa, Unknown
  Description of Unknown: Anti-microbial peptide
ILRRWPWWPWRRK

SEQ ID NO: 1805 - protein, 86 aa, Unknown
  Description of Unknown: Anti-microbial peptide
MNLAKGKEESLDSDLYAELRCMCIKTTSGIHPKNIQSLEVIGKGTHCNQVEVIATLKDGRKICLDPDAPRIKKIVQKKLAGDESAD

SEQ ID NO: 1806 - protein, 24 aa, Unknown
  Description of Unknown: Anti-microbial peptide
KKWWRRVLSGLKTAGPAIQSVLNK

SEQ ID NO: 1807 - protein, 37 aa, Unknown
  Description of Unknown: Anti-microbial peptide
GLRKRLRKFRNKIKEKLKKIGQKIQGLLPKLAPRTDY

SEQ ID NO: 1808 - protein, 32 aa, Unknown
  Description of Unknown: Anti-microbial peptide
LKKLLKKLLKKLLKKLLKKLLKKLLKKLLKKL

SEQ ID NO: 1809 - protein, 16 aa, Unknown
  Description of Unknown: Anti-microbial peptide
IGEDVYTPGISGDSLR

SEQ ID NO: 1810 - protein, 14 aa, Unknown
  Description of Unknown: Anti-microbial peptide
KWKKALRALARHLK

SEQ ID NO: 1811 - protein, 28 aa, Unknown
  Description of Unknown: Anti-microbial peptide
RVIEVVQGACRAIRHIPRRIRQGLRRIL

SEQ ID NO: 1812 - protein, 20 aa, Unknown
  Description of Unknown: Anti-microbial peptide
RRENTQQHITARRAIRHPQY

SEQ ID NO: 1813 - protein, 12 aa, Unknown
  Description of Unknown: Anti-microbial peptide
ILPWKWPWYVRR

SEQ ID NO: 1814 - protein, 5 aa, Unknown
  Description of Unknown: Anti-microbial peptide
PVPMR

SEQ ID NO: 1815 - protein, 18 aa, Unknown
  Description of Unknown: Anti-microbial peptide
KNLRRIIRKSIHIIKKYG

SEQ ID NO: 1816 - protein, 12 aa, Unknown
  Description of Unknown: Anti-microbial peptide
KARHGSCNYVFP

SEQ ID NO: 1817 - protein, 20 aa, Unknown
  Description of Unknown: Anti-microbial peptide
GMASKGAIAGKIAKVALKAL

SEQ ID NO: 1818 - protein, 6 aa, Unknown
  Description of Unknown: Anti-microbial peptide
  MOD_RES (2)..(2): Any amino acid
  MOD_RES (4)..(4): Any amino acid
PXPXPP

SEQ ID NO: 1819 - protein, 25 aa, Unknown
  Description of Unknown: Anti-microbial peptide
NQGRHFCGGALIHARFVMTAARSFQ

SEQ ID NO: 1820 - protein, 11 aa, Unknown
  Description of Unknown: Anti-microbial peptide
KGYFYFLFKFK

SEQ ID NO: 1821 - protein, 19 aa, Unknown
  Description of Unknown: Anti-microbial peptide
  MOD_RES (12)..(12): Any amino acid
RRWCFRVCYRGXFCYRKCR

SEQ ID NO: 1822 - protein, 29 aa, Unknown
  Description of Unknown: Anti-microbial peptide
GWGSFFKKAAHVGKHVGKAALGAAARRRK

SEQ ID NO: 1823 - protein, 12 aa, Unknown
  Description of Unknown: Anti-microbial peptide
ILRRWPWWPWRK

SEQ ID NO: 1824 - protein, 24 aa, Unknown
  Description of Unknown: Anti-microbial peptide
KKWWRRALQGLKTAGPAIQSVLNK

SEQ ID NO: 1825 - protein, 21 aa, Unknown
  Description of Unknown: Anti-microbial peptide
GLRKRLRKFRNKIKEKLKKIG

SEQ ID NO: 1826 - protein, 28 aa, Unknown
  Description of Unknown: Anti-microbial peptide
KWKLFKKIGIGAVLKVLTTGLPALTLTK

SEQ ID NO: 1827 - protein, 28 aa, Unknown
  Description of Unknown: Anti-microbial peptide
KFAFKFAFKFAFKFAFKFAFKFAFKFAF

SEQ ID NO: 1828 - protein, 22 aa, Unknown
  Description of Unknown: Anti-microbial peptide
IGKFLHAAKKFAKAFVAEIMNS

SEQ ID NO: 1829 - protein, 31 aa, Unknown
  Description of Unknown: Anti-microbial peptide
KLKKALRALARHWKAGPGVTIGIAHAKSQLW

SEQ ID NO: 1830 - protein, 37 aa, Unknown
  Description of Unknown: Anti-microbial peptide
  MOD_RES (7)..(7): Any amino acid
GFFKKAXRKVKHAGRRVLDTAKGVGRHYVNNWLNRYR

SEQ ID NO: 1831 - protein, 5 aa, Unknown
  Description of Unknown: Anti-microbial peptide
IVGGR

SEQ ID NO: 1832 - protein, 19 aa, Unknown
  Description of Unknown: Anti-microbial peptide
MASRAAGLAARLARLALRA

SEQ ID NO: 1833 - protein, 14 aa, Unknown
  Description of Unknown: Anti-microbial peptide
RRRFPWWWPFLRRR

SEQ ID NO: 1834 - protein, 25 aa, Unknown
  Description of Unknown: Anti-microbial peptide
  MOD_RES (4)..(4): Any amino acid
  MOD_RES (10)..(10): Any amino acid
  MOD_RES (16)..(16): Any amino acid
  MOD_RES (20)..(20): Any amino acid
RSVXRQIKIXRRRGGXYYKXTNRPT

SEQ ID NO: 1835 - protein, 16 aa, Unknown
  Description of Unknown: Anti-microbial peptide
ILKPWKWPWWPWRRKK

SEQ ID NO: 1836 - protein, 83 aa, Unknown
  Description of Unknown: Anti-microbial peptide
MARSIYFMAFLVLATLFVAYGVQGKEICCKELTKPVKCSSDPLCQKLCMEKEKYEDGHCFTILSKCLCMKRCNAKTLATELLA

SEQ ID NO: 1837 - protein, 45 aa, Unknown; identical to SEQ ID NO: 361
  Description of Unknown: Anti-microbial peptide

SEQ ID NO: 1838 - protein, 36 aa, Unknown; identical to SEQ ID NO: 468
  Description of Unknown: Anti-microbial peptide

SEQ ID NO: 1839 - protein, 15 aa, Unknown
  Description of Unknown: Anti-microbial peptide
CIRLEKARHGSCNYV

SEQ ID NO: 1840 - protein, 19 aa, Unknown
  Description of Unknown: Anti-microbial peptide
GKWKLFKKAFKKFLKILAC

SEQ ID NO: 1841 - protein, 72 aa, Unknown
  Description of Unknown: Anti-microbial peptide
MRLVVCLVFLASFALVCQGEAYRGGYTGPIPRPPPIGRPPFRPVCNACYRLSVSDARNCCIKFGSCCHLVKG

SEQ ID NO: 1842 - protein, 50 aa, Unknown
  Description of Unknown: Anti-microbial peptide
RLCERPSGTWSGVCGNNNACRNQCRNLERAEHGSCNYVFPAHKCICYFPC

SEQ ID NO: 1843 - protein, 20 aa, Unknown
  Description of Unknown: Anti-microbial peptide
RHFCGGALIHARFVMTAASC

SEQ ID NO: 1844 - protein, 13 aa, Unknown
  Description of Unknown: Anti-microbial peptide
  MOD_RES (2)..(2): Any amino acid
  MOD_RES (5)..(7): Any amino acid
  MOD_RES (9)..(11): Any amino acid
  MOD_RES (13)..(13): Any amino acid
NXPAXXXYXXXGX

SEQ ID NO: 1845 - protein, 74 aa, Unknown
  Description of Unknown: Anti-microbial peptide
SDDPKESEGDLHCVCVKTTSLVRPGHITNLELIKAGGHCPTANLIATKKNGRKLCLDLQAALYKKKIIKKLLES

SEQ ID NO: 1846 - protein, 17 aa, Unknown
  Description of Unknown: Anti-microbial peptide
WCFAVCYRGRCRRKCRR

SEQ ID NO: 1847 - protein, 22 aa, Unknown
  Description of Unknown: Anti-microbial peptide
FFHHIFRGIVHVGKTIHRLVTG

SEQ ID NO: 1848 - protein, 15 aa, Unknown
  Description of Unknown: Anti-microbial peptide
RERDHELRHRRHHHQ

SEQ ID NO: 1849 - protein, 36 aa, Unknown; identical to SEQ ID NO: 442
  Description of Unknown: Anti-microbial peptide

SEQ ID NO: 1850 - protein, 25 aa, Unknown
  Description of Unknown: Anti-microbial peptide
KKAAAKAAAAAKAAWAAKAAAKKKK

SEQ ID NO: 1851 - protein, 4 aa, Unknown
  Description of Unknown: Anti-microbial peptide
AELR

SEQ ID NO: 1852 - protein, 18 aa, Unknown
  Description of Unknown: Anti-microbial peptide
KVHGSLARAGKVRGQTPK

SEQ ID NO: 1853 - protein, 31 aa, Unknown
  Description of Unknown: Anti-microbial peptide
RVIRVVQRACRAIRHIVRRIRQGLRRILRVV

SEQ ID NO: 1854 - protein, 26 aa, Unknown
  Description of Unknown: Anti-microbial peptide
KWKSFIKKLTSAAKKVVTTAKPLISS

SEQ ID NO: 1855 - protein, 96 aa, Unknown
  Description of Unknown: Anti-microbial peptide
MKATILLAVLVAVFVAGTEAHSHACTSYWCGKFCGTASCTHYLCRVLHPGKMCACVHCSRVNNPFRVNQVAKSINDLDYTPIMKSMENLDNGMDML

SEQ ID NO: 1856 - protein, 26 aa, Unknown
  Description of Unknown: Anti-microbial peptide
GIGAVLKVLTTGLPALISWIGGGGGG

SEQ ID NO: 1857 - protein, 29 aa, Unknown
  Description of Unknown: Anti-microbial peptide
RGLRRLGRKIAHGVKKYGPTVLRIIRIAG

SEQ ID NO: 1858 - protein, 17 aa, Unknown
  Description of Unknown: Anti-microbial peptide
GSSKSPSKDKDKDPGDC

SEQ ID NO: 1859 - protein, 20 aa, Unknown
  Description of Unknown: Anti-microbial peptide
KFAKKFAKKFAKKFAKKFAK

SEQ ID NO: 1860 - protein, 8 aa, Unknown
  Description of Unknown: Anti-microbial peptide
HFRWGKPV

SEQ ID NO: 1861 - protein, 18 aa, Unknown
  Description of Unknown: Anti-microbial peptide
GICRCICGKGICRCICGR

SEQ ID NO: 1862 - protein, 23 aa, Unknown
  Description of Unknown: Anti-microbial peptide
GIGKFLREAGKFGKAFVGEIMKP

SEQ ID NO: 1863 - protein, 14 aa, Unknown
  Description of Unknown: Anti-microbial peptide
KLKKALRWLARHAK

SEQ ID NO: 1864 - protein, 21 aa, Unknown
  Description of Unknown: Anti-microbial peptide
RVIRVVQGACRAIRHIPRRIR

SEQ ID NO: 1865 - protein, 20 aa, Unknown
  Description of Unknown: Anti-microbial peptide
HPQYNQRTIQNDIMLLQLSR

SEQ ID NO: 1866 - protein, 9 aa, Unknown
  Description of Unknown: Anti-microbial peptide
IKWPWYVWL

SEQ ID NO: 1867 - protein, 4 aa, Unknown
  Description of Unknown: Anti-microbial peptide
PTHG

SEQ ID NO: 1868 - protein, 18 aa, Unknown
  Description of Unknown: Anti-microbial peptide
KNLRRIIRKEIHIIKKYG

SEQ ID NO: 1869 - protein, 12 aa, Unknown
  Description of Unknown: Anti-microbial peptide
RHGSCNYVFPAH

SEQ ID NO: 1870 - protein, 14 aa, Unknown
  Description of Unknown: Anti-microbial peptide
SSSKEENRIIPGGI

SEQ ID NO: 1871 - protein, 24 aa, Unknown
  Description of Unknown: Anti-microbial peptide
  MOD_RES (2)..(4): Any amino acid
  MOD_RES (6)..(15): Any amino acid
  MOD_RES (18)..(22): Any amino acid
CXXXCXXXXXXXXXXCCXXXXXCC

SEQ ID NO: 1872 - protein, 80 aa, Unknown
  Description of Unknown: Anti-microbial peptide
MAKFASIIALLFAALVLFAAFEAETMVEAQKLCERPSGTWSGVCGNNNACKNQCINLEKARHGSCNYVFPAHKCICYFPC

SEQ ID NO: 1873 - protein, 25 aa, Unknown
  Description of Unknown: Anti-microbial peptide
NQGRHFCGGALIHARFVMTAAKSFQ

SEQ ID NO: 1874 - protein, 11 aa, Unknown
  Description of Unknown: Anti-microbial peptide
KWKWWWWWKWK

SEQ ID NO: 1875 - protein, 30 aa, Unknown
  Description of Unknown: Anti-microbial peptide
ALWKTMLKKAAHVGKHVGKAALGAAARRRK

SEQ ID NO: 1876 - protein, 12 aa, Unknown
  Description of Unknown: Anti-microbial peptide
ILKWPWWPWRRK

SEQ ID NO: 1877 - protein, 22 aa, Unknown
  Description of Unknown: Anti-microbial peptide
KKWWKAQKAVNSGPNALQTLAQ

SEQ ID NO: 1878 - protein, 18 aa, Unknown
  Description of Unknown: Anti-microbial peptide
KRLRKFRNKIKEKLKKIG

SEQ ID NO: 1879 - protein, 28 aa, Unknown
  Description of Unknown: Anti-microbial peptide
KFFKKFFKKFFKKFFKKFFKKFFKKFFK

SEQ ID NO: 1880 - protein, 9 aa, Unknown
  Description of Unknown: Anti-microbial peptide
RCLCGRGIC

SEQ ID NO: 1881 - protein, 32 aa, Unknown
  Description of Unknown: Anti-microbial peptide
MGRIARGSKMSSLIVSLLVVLVSLNLASETTA

SEQ ID NO: 1882 - protein, 14 aa, Unknown
  Description of Unknown: Anti-microbial peptide
GAYRAIRHIPRRIR

SEQ ID NO: 1883 - protein, 21 aa, Unknown
  Description of Unknown: Anti-microbial peptide
RVIEVVRGACRAIRHIPRRIR

SEQ ID NO: 1884 - protein, 20 aa, Unknown
  Description of Unknown: Anti-microbial peptide
RVRRNRNVNPVALPRAQEGL

SEQ ID NO: 1885 - protein, 36 aa, Unknown
  Description of Unknown: Anti-microbial peptide
  MOD_RES (1)..(3): Any amino acid
  MOD_RES (6)..(7): Any amino acid
  MOD_RES (9)..(9): Any amino acid
  MOD_RES (11)..(11): Any amino acid
  MOD_RES (13)..(13): Any amino acid
  MOD_RES (20)..(21): Any amino acid
  MOD_RES (28)..(28): Any amino acid
  MOD_RES (31)..(32): Any amino acid
XXXYCXXNXGXCXPIRCPGXXRQIGTCXGZXXKCCR

SEQ ID NO: 1886 - protein, 15 aa, Unknown
  Description of Unknown: Anti-microbial peptide
ILPWKWFFPPWPWRR

SEQ ID NO: 1887 - protein, 36 aa, Unknown
  Description of Unknown: Anti-microbial peptide
  MOD_RES (1)..(4): Any amino acid
  MOD_RES (6)..(7): Any amino acid
  MOD_RES (9)..(9): Any amino acid
  MOD_RES (11)..(11): Any amino acid
  MOD_RES (13)..(13): Any amino acid
  MOD_RES (20)..(21): Any amino acid
  MOD_RES (28)..(28): Any amino acid
  MOD_RES (30)..(32): Any amino acid
XXXXCXXNXGXCXPIRCPGXXRQIGTCXGXXXKCCR

SEQ ID NO: 1888 - protein, 18 aa, Unknown
  Description of Unknown: Anti-microbial peptide
KNLRRIIRKDIHIIKKYG

SEQ ID NO: 1889 - protein, 12 aa, Unknown
  Description of Unknown: Anti-microbial peptide
HGSCNYVFPAHK

SEQ ID NO: 1890 - protein, 19 aa, Unknown
  Description of Unknown: Anti-microbial peptide
LLASDEEIQDVSGTWYLKA

SEQ ID NO: 1891 - protein, 12 aa, Unknown
  Description of Unknown: Anti-microbial peptide
  MOD_RES (2)..(2): Any amino acid
  MOD_RES (4)..(4): Any amino acid
  MOD_RES (7)..(9): Any amino acid
  MOD_RES (11)..(12): Any amino acid
PXPXPPXXXPXX

SEQ ID NO: 1892 - protein, 20 aa, Unknown
  Description of Unknown: Anti-microbial peptide
RHFSGGALIHARFVMTAAHC

SEQ ID NO: 1893 - protein, 13 aa, Unknown
  Description of Unknown: Anti-microbial peptide
PRIKKIVQKKLAG

SEQ ID NO: 1894 - protein, 29 aa, Unknown
  Description of Unknown: Anti-microbial peptide
SIGSAFKKAAHVGKHVGKAALGAAARRRK

SEQ ID NO: 1895 - protein, 12 aa, Unknown
  Description of Unknown: Anti-microbial peptide
ILKKWPWWPWRK

SEQ ID NO: 1896 - protein, 47 aa, Unknown
  Description of Unknown: Anti-microbial peptide
RVCMKGSAGFKGLCMRDQNCAQVCLQEGWGGGNCDGVMRQCKCIRQC

SEQ ID NO: 1897 - protein, 22 aa, Unknown
  Description of Unknown: Anti-microbial peptide
KKWWKAKKFANSGPNALQTLAQ

SEQ ID NO: 1898 - protein, 22 aa, Unknown
  Description of Unknown: Anti-microbial peptide
RKRLRKFRNKIKEKLKKIGQKI

SEQ ID NO: 1899 - protein, 28 aa, Unknown
  Description of Unknown: Anti-microbial peptide
KFAKKFAKKFAKKFAKKFAKKFAKKFAK

SEQ ID NO: 1900 - protein, 9 aa, Unknown
  Description of Unknown: Anti-microbial peptide
RCICRRGIC

SEQ ID NO: 1901 - protein, 28 aa, Unknown
  Description of Unknown: Anti-microbial peptide
MGKNGSLCCFSLLLLLLLAGLASGHQVL

SEQ ID NO: 1902 - protein, 15 aa, Unknown
  Description of Unknown: Anti-microbial peptide
RRIYRAIRHIPRRIR

SEQ ID NO: 1903 - protein, 21 aa, Unknown
  Description of Unknown: Anti-microbial peptide
RVIEVVQGICRAIRHIPRRIR

SEQ ID NO: 1904 - protein, 20 aa, Unknown
  Description of Unknown: Anti-microbial peptide
RPGTLCTVAGWGRVSMRRGT

SEQ ID NO: 1905 - protein, 29 aa, Unknown
  Description of Unknown: Anti-microbial peptide
MGECVRGRCPSGMCCSQFGYCGKGPKYCG

SEQ ID NO: 1906 - protein, 16 aa, Unknown
  Description of Unknown: Anti-microbial peptide
ILPWKWPPWPPWPWRR

SEQ ID NO: 1907 - protein, 31 aa, Unknown
  Description of Unknown: Anti-microbial peptide
  MOD_RES (1)..(2): Any amino acid
  MOD_RES (4)..(4): Any amino acid
  MOD_RES (6)..(9): Any amino acid
  MOD_RES (11)..(14): Any amino acid
  MOD_RES (16)..(17): Any amino acid
  MOD_RES (19)..(19): Any amino acid
  MOD_RES (21)..(29): Any amino acid
XXCXCXXXXCXXXXRXXGXCXXXXXXXXXCC

SEQ ID NO: 1908 - protein, 18 aa, Unknown
  Description of Unknown: Anti-microbial peptide
KNLRRIIRKAIHIIKKYG

SEQ ID NO: 1909 - protein, 19 aa, Unknown
  Description of Unknown: Anti-microbial peptide
ARHGSCNYVFPAHKCICYF

SEQ ID NO: 1910 - protein, 18 aa, Unknown
  Description of Unknown: Anti-microbial peptide
  MOD_RES (2)..(2): Any amino acid
  MOD_RES (4)..(4): Any amino acid
  MOD_RES (7)..(9): Any amino acid
  MOD_RES (11)..(11): Any amino acid
  MOD_RES (13)..(14): Any amino acid
  MOD_RES (16)..(17): Any amino acid
PXPXPPXXXPXPXXPXXP

SEQ ID NO: 1911 - protein, 20 aa, Unknown
  Description of Unknown: Anti-microbial peptide
RHFSGGALIHARFVMTAARC

SEQ ID NO: 1912 - protein, 19 aa, Unknown
  Description of Unknown: Anti-microbial peptide
KWVREYINSLEMSKKGLAG

SEQ ID NO: 1913 - protein, 11 aa, Unknown
  Description of Unknown: Anti-microbial peptide
ILKWPWWPWRK

SEQ ID NO: 1914 - protein, 51 aa, Unknown
  Description of Unknown: Anti-microbial peptide
QKLCMRPSGTWSGVCGNNNACKNQCIRLEKARHGSCNYVFPAHKCICYFPC

SEQ ID NO: 1915 - protein, 23 aa, Unknown
  Description of Unknown: Anti-microbial peptide
KKWWKFIKKAVNSGTTGLQTLAS

SEQ ID NO: 1916 - protein, 19 aa, Unknown
  Description of Unknown: Anti-microbial peptide
LRKFRNKIKEKLKKIGQKI

SEQ ID NO: 1917 - protein, 28 aa, Unknown
  Description of Unknown: Anti-microbial peptide
KAAKKAAKKAAKKAAKKAAKKAAKKAAK

SEQ ID NO: 1918 - protein, 9 aa, Unknown
  Description of Unknown: Anti-microbial peptide
RCICTRGIC

SEQ ID NO: 1919 - protein, 15 aa, Unknown
  Description of Unknown: Anti-microbial peptide
GGGGSGGGGSGGGGS

SEQ ID NO: 1920 - protein, 21 aa, Unknown
  Description of Unknown: Anti-microbial peptide
RVIEVVQGACRAIRRIPRRIR

SEQ ID NO: 1921 - protein, 20 aa, Unknown
  Description of Unknown: Anti-microbial peptide
DTLREVQLRVQRDRQCLRIF

SEQ ID NO: 1922 - protein, 20 aa, Unknown
  Description of Unknown: Anti-microbial peptide
  MOD_RES (1)..(2): Any amino acid
  MOD_RES (4)..(6): Any amino acid
  MOD_RES (8)..(9): Any amino acid
  MOD_RES (11)..(12): Any amino acid
  MOD_RES (14)..(20): Any amino acid
XXPXXXPXXPXXPXXXXXXX

SEQ ID NO: 1923 - protein, 19 aa, Unknown
  Description of Unknown: Anti-microbial peptide
ASHGACHKRENHWKCFCYF

SEQ ID NO: 1924 - protein, 82 aa, Unknown
  Description of Unknown: Anti-microbial peptide
MRLVVCLVFLASFALVCQGQVYKGGYTRPVPRPPPFVRPLPGGPIGPYNGCPVSCRGISFSQARSCCSRLGRCCHVGKGYSG

SEQ ID NO: 1925 - protein, 20 aa, Unknown
  Description of Unknown: Anti-microbial peptide
RHFSGGALIHARFVMTAAKC

SEQ ID NO: 1926 - protein, 20 aa, Unknown
  Description of Unknown: Anti-microbial peptide
EWVQKYVSDLELSAWKKILK

SEQ ID NO: 1927 - protein, 33 aa, Unknown
  Description of Unknown: Anti-microbial peptide
ALWKTMLKKLGTMALHAGKAALGAAADTISQTQ

SEQ ID NO: 1928 - protein, 51 aa, Unknown
  Description of Unknown: Anti-microbial peptide
QKLCQRPSGGWSGVCGNNNACKNQCIRLEKARHGSCNYVFPAHKCICYFPC

SEQ ID NO: 1929 - protein, 17 aa, Unknown
  Description of Unknown: Anti-microbial peptide
KKSFFKKLTSVASSVLS

SEQ ID NO: 1930 - protein, 21 aa, Unknown
  Description of Unknown: Anti-microbial peptide
LRKFRNKIKEKLKKIGQKIQG

SEQ ID NO: 1931 - protein, 28 aa, Unknown
  Description of Unknown: Anti-microbial peptide
KKAKKKAKKKAKKKAKKKAKKKAKKKAK

SEQ ID NO: 1932 - protein, 9 aa, Unknown
  Description of Unknown: Anti-microbial peptide
RCICVRGIC

SEQ ID NO: 1933 - protein, 28 aa, Unknown
  Description of Unknown: Anti-microbial peptide
RVIRVVQGACRAIRHIPRRIRQGLERIL

SEQ ID NO: 1934 - protein, 20 aa, Unknown
  Description of Unknown: Anti-microbial peptide
GSYDPRRQICVGDRRERKAA

SEQ ID NO: 1935 - protein, 18 aa, Unknown
  Description of Unknown: Anti-microbial peptide
  MOD_RES (1)..(2): Any amino acid
  MOD_RES (4)..(14): Any amino acid
  MOD_RES (16)..(18): Any amino acid
XXPXXXXXXXXXXXPXXX

SEQ ID NO: 1936 - protein, 18 aa, Unknown
  Description of Unknown: Anti-microbial peptide
KNLRRIIRKIGHIIKKYG

SEQ ID NO: 1937 - protein, 19 aa, Unknown
  Description of Unknown: Anti-microbial peptide
AAHGACHVRNGKHMCFCYF

SEQ ID NO: 1938 - protein, 81 aa, Unknown
  Description of Unknown: Anti-microbial peptide
MRLVVCLVFLASFALVCQGQVYKGGYTRPIPRPPFVRPVPGGPIGPYNGCPVSCRGISFSQARSCCSRLGRCCHVGKGYSG

SEQ ID NO: 1939 - protein, 20 aa, Unknown
  Description of Unknown: Anti-microbial peptide
RHFCGGALIHARFVMTAAHS

SEQ ID NO: 1940 - protein, 12 aa, Unknown
  Description of Unknown: Anti-microbial peptide
SWVQEYVYDLEL

SEQ ID NO: 1941 - protein, 12 aa, Unknown
  Description of Unknown: Anti-microbial peptide
KRRWPWWPWRLI

SEQ ID NO: 1942 - protein, 51 aa, Unknown
  Description of Unknown: Anti-microbial peptide
QKLCQRPSGTSSGVCGNNNACKNQCIRLEKARHGSCNYVFPAHKCICYFPC

SEQ ID NO: 1943 - protein, 20 aa, Unknown
  Description of Unknown: Anti-microbial peptide
WKVFKSFIKKASSFAQSVLD

SEQ ID NO: 1944 - protein, 15 aa, Unknown
  Description of Unknown: Anti-microbial peptide
RKFRNKIKEKLKKIG

SEQ ID NO: 1945 - protein, 15 aa, Unknown
  Description of Unknown: Anti-microbial peptide
KFKKFKKFKKFKKFK

SEQ ID NO: 1946 - protein, 9 aa, Unknown
  Description of Unknown: Anti-microbial peptide
RCICGLGIC

SEQ ID NO: 1947 - protein, 84 aa, Unknown
  Description of Unknown: Anti-microbial peptide
MALSSQIWAACLLLLLLLASLTSGSVFPQQTGQLAELQPQDRAGARASWMPMFQRRRRRDTHFPICIFCCGCCHRSKCGMCCKT

SEQ ID NO: 1948 - protein, 28 aa, Unknown
  Description of Unknown: Anti-microbial peptide
RVIEVVRGACRAIRHIPRRIRQGLERIL

SEQ ID NO: 1949 - protein, 21 aa, Unknown
  Description of Unknown: Anti-microbial peptide
FKGDSGGPLLCNNVAHGIVSY

SEQ ID NO: 1950 - protein, 20 aa, Unknown
  Description of Unknown: Anti-microbial peptide
  MOD_RES (1)..(3): Any amino acid
  MOD_RES (6)..(20): Any amino acid
XXXPWXXXXXXXXXXXXXXX

SEQ ID NO: 1951 - protein, 18 aa, Unknown
  Description of Unknown: Anti-microbial peptide
KNLRRIIRKITHIIKKYG

SEQ ID NO: 1952 - protein, 20 aa, Unknown
  Description of Unknown: Anti-microbial peptide
RHFCGGALIHARFVMTAARS

SEQ ID NO: 1953 - protein, 16 aa, Unknown
  Description of Unknown: Anti-microbial peptide
ADSGEGDFLAEGGGVR

SEQ ID NO: 1954 - protein, 11 aa, Unknown
  Description of Unknown: Anti-microbial peptide
ILWPWWPWRRK

SEQ ID NO: 1955 - protein, 51 aa, Unknown
  Description of Unknown: Anti-microbial peptide
QKLCQRPSGTWSGVCMNNNACKNQCIRLEKARHGSCNYVFPAHKCICYFPC

SEQ ID NO: 1956 - protein, 18 aa, Unknown
  Description of Unknown: Anti-microbial peptide
KKWRKSFFKQVGSFDNSV

SEQ ID NO: 1957 - protein, 15 aa, Unknown
  Description of Unknown: Anti-microbial peptide
KIKEKLKKIGQKIQG

SEQ ID NO: 1958 - protein, 12 aa, Unknown
  Description of Unknown: Anti-microbial peptide
RLSRIVVIRVSR

SEQ ID NO: 1959 - protein, 18 aa, Unknown
  Description of Unknown: Anti-microbial peptide
KFKKFKKFKKFKKFKKFK

SEQ ID NO: 1960 - protein, 9 aa, Unknown
  Description of Unknown: Anti-microbial peptide
RCICGRGVC

SEQ ID NO: 1961 - protein, 28 aa, Unknown
  Description of Unknown: Anti-microbial peptide
RVIEVVQGICRAIRHIPRRIRQGLERIL

SEQ ID NO: 1962 - protein, 27 aa, Unknown
  Description of Unknown: Anti-microbial peptide
GKSSGVPPEVFTRFVSSFLPWIRTTMR

SEQ ID NO: 1963 - protein, 18 aa, Unknown
  Description of Unknown: Anti-microbial peptide
  MOD_RES (1)..(5): Any amino acid
  MOD_RES (7)..(8): Any amino acid
  MOD_RES (10)..(11): Any amino acid
  MOD_RES (13)..(18): Any amino acid
XXXXXPXXPXXPXXXXXX

SEQ ID NO: 1964 - protein, 18 aa, Unknown
  Description of Unknown: Anti-microbial peptide
KNLRRIIRKISHIIKKYG

SEQ ID NO: 1965 - protein, 20 aa, Unknown
  Description of Unknown: Anti-microbial peptide
RHFCGGALIHARFVMTAAKS

SEQ ID NO: 1966 - protein, 20 aa, Unknown
  Description of Unknown: Anti-microbial peptide
ADSGEGDFLAEGGGVRKLIK

SEQ ID NO: 1967 - protein, 13 aa, Unknown
  Description of Unknown: Anti-microbial peptide
ILRRWPWWPWRRR

SEQ ID NO: 1968 - protein, 51 aa, Unknown
  Description of Unknown: Anti-microbial peptide
QKLCQRPSGTWSGVCGNNNACKNQCIRLEKWRHGSCNYVFPAHKCICYFPC

SEQ ID NO: 1969 - protein, 26 aa, Unknown
  Description of Unknown: Anti-microbial peptide
  MOD_RES (4)..(15): Any amino acid
KWKXXXXXXXXXXXXVLTTGLPALIS

SEQ ID NO: 1970 - protein, 17 aa, Unknown
  Description of Unknown: Anti-microbial peptide
KIKEKLKKIGQKIQGLL

SEQ ID NO: 1971 - protein, 10 aa, Unknown
  Description of Unknown: Anti-microbial peptide
  MOD_RES (3)..(4): Any amino acid
  MOD_RES (8)..(9): Any amino acid
PFXXVPFXXV

SEQ ID NO: 1972 - protein, 21 aa, Unknown
  Description of Unknown: Anti-microbial peptide
KFKKFKKFKKFKKFKKFKKFK

SEQ ID NO: 1973 - protein, 28 aa, Unknown
  Description of Unknown: Anti-microbial peptide
RVIEVVQGACRAIRRIPRRIRQGLERIL

SEQ ID NO: 1974 - protein, 7 aa, Unknown
  Description of Unknown: Anti-microbial peptide
APQYNQR

SEQ ID NO: 1975 - protein, 12 aa, Unknown
  Description of Unknown: Anti-microbial peptide
ILKKWPWWRWRR

SEQ ID NO: 1976 - protein, 18 aa, Unknown
  Description of Unknown: Anti-microbial peptide
KNLRRIIRKIEHIIKKYG

SEQ ID NO: 1977 - protein, 25 aa, Unknown
  Description of Unknown: Anti-microbial peptide
NQGRHFCAGALIHARFVMTAASCFQ

SEQ ID NO: 1978 - protein, 13 aa, Unknown
  Description of Unknown: Anti-microbial peptide
EGVNDNEEGFFSA

SEQ ID NO: 1979 - protein, 13 aa, Unknown
  Description of Unknown: Anti-microbial peptide
ILKKWPWWPWKKK

SEQ ID NO: 1980 - protein, 51 aa, Unknown
  Description of Unknown: Anti-microbial peptide
QKLCQRPSGTWSGVCGNNNACKNQCIRLEKARHGSCNGVFPAHKCICYFPC

SEQ ID NO: 1981 - protein, 26 aa, Unknown
  Description of Unknown: Anti-microbial peptide
  MOD_RES (4)..(15): Any amino acid
KWKXXXXXXXXXXXXVVTTAKPLISS

SEQ ID NO: 1982 - protein, 28 aa, Unknown
  Description of Unknown: Anti-microbial peptide
RGLRRLGRKIAHGVKKYGPTVLRIIRIA

SEQ ID NO: 1983 - protein, 14 aa, Unknown
  Description of Unknown: Anti-microbial peptide
  MOD_RES (1)..(1): Any amino acid
  MOD_RES (7)..(8): Any amino acid
XVKLKVXXLKVKLY

SEQ ID NO: 1984 - protein, 24 aa, Unknown
  Description of Unknown: Anti-microbial peptide
KFKKFKKFKKFKKFKKFKKFKKFK

SEQ ID NO: 1985 - protein, 17 aa, Unknown
  Description of Unknown: Anti-microbial peptide
VVRGACRAIRHIPRRIR

SEQ ID NO: 1986 - protein, 5 aa, Unknown
  Description of Unknown: Anti-microbial peptide
IIGGH

SEQ ID NO: 1987 - protein, 18 aa, Unknown
  Description of Unknown: Anti-microbial peptide
KNLRRIIRKIDHIIKKYG

SEQ ID NO: 1988 - protein, 25 aa, Unknown
  Description of Unknown: Anti-microbial peptide
NQGRHFCGAALIHARFVMTAASCFQ

SEQ ID NO: 1989 - protein, 18 aa, Unknown
  Description of Unknown: Anti-microbial peptide
KFDKSKLKKTETQEKNPL

SEQ ID NO: 1990 - protein, 21 aa, Unknown
  Description of Unknown: Anti-microbial peptide
ILRWPWWPWRRKIMILKKAGS

SEQ ID NO: 1991 - protein, 51 aa, Unknown
  Description of Unknown: Anti-microbial peptide
QKLCQRPSGTWSGVCGNNNACKNQCIRLEKARHGSCNYVMPAHKCICYFPC

SEQ ID NO: 1992 - protein, 26 aa, Unknown
  Description of Unknown: Anti-microbial peptide
  MOD_RES (4)..(15): Any amino acid
KWKXXXXXXXXXXXXILTTGLPALIS

SEQ ID NO: 1993 - protein, 29 aa, Unknown
  Description of Unknown: Anti-microbial peptide
KNLRRIIRKIIHIIKKYGPTILRIIRIIG

SEQ ID NO: 1994 - protein, 27 aa, Unknown
  Description of Unknown: Anti-microbial peptide
KFKKFKKFKKFKKFKKFKKFKKFKKFK

SEQ ID NO: 1995 - protein, 9 aa, Unknown
  Description of Unknown: Anti-microbial peptide
RCLCTRGIC

SEQ ID NO: 1996 - protein, 17 aa, Unknown
  Description of Unknown: Anti-microbial peptide
VVQGICRAIRHIPRRIR

SEQ ID NO: 1997 - protein, 5 aa, Unknown
  Description of Unknown: Anti-microbial peptide
IIGGV

SEQ ID NO: 1998 - protein, 13 aa, Unknown
  Description of Unknown: Anti-microbial peptide
ILKKFPFFPFKKK

SEQ ID NO: 1999 - protein, 18 aa, Unknown
  Description of Unknown: Anti-microbial peptide
KNLRRIIRKIAHIIKKYG

SEQ ID NO: 2000 - protein, 20 aa, Unknown
  Description of Unknown: Anti-microbial peptide
KARHGSCNYVFPAHKCICYF

SEQ ID NO: 2001 - protein, 25 aa, Unknown
  Description of Unknown: Anti-microbial peptide
NQGRHFCAAALIHARFVMTAASCFQ

SEQ ID NO: 2002 - protein, 15 aa, Unknown
  Description of Unknown: Anti-microbial peptide
ANLIATKKNGRKLCL

SEQ ID NO: 2003 - protein, 20 aa, Unknown
  Description of Unknown: Anti-microbial peptide
ILRWPWWPWRRKMILKKAGS

SEQ ID NO: 2004 - protein, 51 aa, Unknown
  Description of Unknown: Anti-microbial peptide
QKLCQRPSGTWSGVCGNNNACKNQCIRLEKARHGSCNYVFPAHQCICYFPC

SEQ ID NO: 2005 - protein, 26 aa, Unknown
  Description of Unknown: Anti-microbial peptide
  MOD_RES (4)..(15): Any amino acid
KWKXXXXXXXXXXXXGGLLSNIVTSL

SEQ ID NO: 2006 - protein, 18 aa, Unknown
  Description of Unknown: Anti-microbial peptide
RGLRALGRKIAHGVKAYG

SEQ ID NO: 2007 - protein, 26 aa, Unknown
  Description of Unknown: Anti-microbial peptide
GIGAVLKVLTTGLPALISWIKRKRQQ

SEQ ID NO: 2008 - protein, 30 aa, Unknown
  Description of Unknown: Anti-microbial peptide
KFKKFKKFKKFKKFKKFKKFKKFKKFKKFK

SEQ ID NO: 2009 - protein, 9 aa, Unknown
  Description of Unknown: Anti-microbial peptide
RCLCVRGIC

SEQ ID NO: 2010 - protein, 68 aa, Unknown
  Description of Unknown: Anti-microbial peptide
MRTSYLLLFTLCLLLSEMASGGNFLTGLGHRSDHYNCVSSGGQCLYSACPIFTKIQGTCYRGKAKCCK

SEQ ID NO: 2011 - protein, 23 aa, Unknown
  Description of Unknown: Anti-microbial peptide
GIGKFLHAAKKFAKAFVAEIMNS

SEQ ID NO: 2012 - protein, 23 aa, Unknown
  Description of Unknown: Anti-microbial peptide
  MOD_RES (5)..(8): Any amino acid
  MOD_RES (10)..(13): Any amino acid
  MOD_RES (18)..(19): Any amino acid
  MOD_RES (21)..(23): Any amino acid
GIGKXXXXAXXXXKAFVXXIXXX

SEQ ID NO: 2013 - protein, 40 aa, Unknown
  Description of Unknown: Anti-microbial peptide
QRAVRRIYRAIRHIPRRIRIRALAGPGVTIGIAHAKSQLW

SEQ ID NO: 2014 - protein, 28 aa, Unknown
  Description of Unknown: Anti-microbial peptide
DLWETLRRGGRWILAIPRRIRQGLELTL

SEQ ID NO: 2015 - protein, 30 aa, Unknown
  Description of Unknown: Anti-microbial peptide
  MOD_RES (2)..(2): Any amino acid
  MOD_RES (7)..(7): Any amino acid
GXFKKAXRKVKNAGRRVLKGVGIHYGVGLI

SEQ ID NO: 2016 - protein, 7 aa, Unknown
  Description of Unknown: Anti-microbial peptide
HPQYNQR

SEQ ID NO: 2017 - protein, 20 aa, Unknown
  Description of Unknown: Anti-microbial peptide
MASRAAGLAARLARLALRAL

SEQ ID NO: 2018 - protein, 80 aa, Unknown
  Description of Unknown: Anti-microbial peptide
MKTTILILLILGLGINAKSLEERKSEEEKVFQFLGKIIHHVGNFVHGFSHVFGDDQQDNGKFYGHYAEDNGKHWYDTGDQ

SEQ ID NO: 2019 - protein, 14 aa, Unknown
  Description of Unknown: Anti-microbial peptide
ILKPWKWPWWPWRR

SEQ ID NO: 2020 - protein, 42 aa, Unknown; identical to SEQ ID NO: 23
  Description of Unknown: Anti-microbial peptide

SEQ ID NO: 2021 - protein, 9 aa, Unknown
  Description of Unknown: Anti-microbial peptide
ALRLAIRKR

SEQ ID NO: 2022 - protein, 18 aa, Unknown
  Description of Unknown: Anti-microbial peptide
KNLRRGIRKIIHIIKKYG

SEQ ID NO: 2023 - protein, 15 aa, Unknown
  Description of Unknown: Anti-microbial peptide
EKARHGSCNYVFPAH

SEQ ID NO: 2024 - protein, 19 aa, Unknown
  Description of Unknown: Anti-microbial peptide
GKWKAFKKAFKKFAKILAG

SEQ ID NO: 2025 - protein, 14 aa, Unknown
  Description of Unknown: Anti-microbial peptide
KRLFKELKKSLRKY

SEQ ID NO: 2026 - protein, 190 aa, Unknown
  Description of Unknown: Anti-microbial peptide
MSRRYTPLAWVLLALLGLGAAQDCGSIVSRGKWGALASKCSQRLRQPVRYVVVSHTAGSVCNTPASCQRQAQNVQYYHVRERGWCDVGYNFKIGEDGKVYEGRGWNTKGDHSGPTWNPIAIGISFMGNYMHRVFFASALRAAQSLLACGAARGYLTPNYEVKGHRDVQQTLSPGDELYKIIQQWPHYRRV

SEQ ID NO: 2027 - protein, 25 aa, Unknown
  Description of Unknown: Anti-microbial peptide
NQGRHFSGGALIHARFVMTAASCFQ

SEQ ID NO: 2028 - protein, 20 aa, Unknown
  Description of Unknown: Anti-microbial peptide
IEDISVAKSEQGKKLGYYLV

SEQ ID NO: 2029 - protein, 18 aa, Unknown
  Description of Unknown: Anti-microbial peptide
ALYKKFKKKLLKSLKRLG

SEQ ID NO: 2030 - protein, 18 aa, Unknown
  Description of Unknown: Anti-microbial peptide
FRWCFRVCYKGRCRYKCR

SEQ ID NO: 2031 - protein, 34 aa, Unknown
  Description of Unknown: Anti-microbial peptide
SPKSHFELPHYPGLLAHQKPFIRKSYKCLHKRCR

SEQ ID NO: 2032 - protein, 27 aa, Unknown
  Description of Unknown: Anti-microbial peptide
KWKSFIKKLTSAAKKVVTTAKPLALIS

SEQ ID NO: 2033 - protein, 68 aa, Unknown
  Description of Unknown: Anti-microbial peptide
AELRCMCIKTTSGIHPKNIQSLEVIGKGTHCNQVEVIATLKDGRKICLDPDAPRIKKIVQKKLAGDES

SEQ ID NO: 2034 - protein, 22 aa, Unknown
  Description of Unknown: Anti-microbial peptide
  MOD_RES (22)..(22): Any amino acid
GIGKFLKKAKKFGKAFVKILKX

SEQ ID NO: 2035 - protein, 13 aa, Unknown
  Description of Unknown: Anti-microbial peptide
TGRAKRRMQYNRR

SEQ ID NO: 2036 - protein, 31 aa, Unknown
  Description of Unknown: Anti-microbial peptide
RWIRVVQRWCRAIRHIWRRIRQGLRRWLRVV

SEQ ID NO: 2037 - protein, 26 aa, Unknown
  Description of Unknown: Anti-microbial peptide
KWKSFIKNLTKGGSKILTTGLPALIS

SEQ ID NO: 2038 - protein, 21 aa, Unknown
  Description of Unknown: Anti-microbial peptide
KIAHGVKKYGPTVLRIIRIAG

SEQ ID NO: 2039 - protein, 27 aa, Unknown
  Description of Unknown: Anti-microbial peptide
GIGAVLKVLTTGLPALISWIKRKRQQC

SEQ ID NO: 2040 - protein, 24 aa, Unknown
  Description of Unknown: Anti-microbial peptide
KFAKKFAKKFAKKFAKKFAKKFAK

SEQ ID NO: 2041 - protein, 13 aa, Unknown
  Description of Unknown: Anti-microbial peptide
SYSMEHFRWGKPV

SEQ ID NO: 2042 - protein, 18 aa, Unknown
  Description of Unknown: Anti-microbial peptide
GICRCYCGRGICRCICGR

SEQ ID NO: 2043 - protein, 17 aa, Unknown
  Description of Unknown: Anti-microbial peptide
VVQRACRAIRRIPRRIR

SEQ ID NO: 2044 - protein, 7 aa, Unknown
  Description of Unknown: Anti-microbial peptide
HPQYNPQ

SEQ ID NO: 2045 - protein, 64 aa, Unknown
  Description of Unknown: Anti-microbial peptide
MRLHHLLLALLFLVLSAWSGFTQGVGNPVSCVRNKGICVPIRCPGSMKQIGTCVGRAVKCCRKK

SEQ ID NO: 2046 - protein, 25 aa, Unknown
  Description of Unknown: Anti-microbial peptide
NQGRHFSAGALIHARFVMTAASCFQ

SEQ ID NO: 2047 - protein, 12 aa, Unknown
  Description of Unknown: Anti-microbial peptide
  MOD_RES (1)..(2): Any amino acid
  MOD_RES (4)..(8): Any amino acid
  MOD_RES (10)..(12): Any amino acid
XXYXXXXXKXXX

SEQ ID NO: 2048 - protein, 21 aa, Unknown
  Description of Unknown: Anti-microbial peptide
ILRWPWWPWRRKDMILKKAGS

SEQ ID NO: 2049 - protein, 51 aa, Unknown
  Description of Unknown: Anti-microbial peptide
QKLCQRPSGTWSGVCGNNNACKNQCIRLEKARHGSCNYVPPAHKCICIFPC

SEQ ID NO: 2050 - protein, 26 aa, Unknown
  Description of Unknown: Anti-microbial peptide
  MOD_RES (4)..(15): Any amino acid
KWKXXXXXXXXXXXXGPILANLVSIV

SEQ ID NO: 2051 - protein, 16 aa, Unknown
  Description of Unknown: Anti-microbial peptide
NLRRIIRKIIHIIKKY

SEQ ID NO: 2052 - protein, 26 aa, Unknown
  Description of Unknown: Anti-microbial peptide
  MOD_RES (5)..(5): Any amino acid
  MOD_RES (8)..(8): Any amino acid
  MOD_RES (17)..(17): Any amino acid
  MOD_RES (21)..(21): Any amino acid
GIGAXLKXLTTGLPALXSWIXRKRQQ

SEQ ID NO: 2053 - protein, 36 aa, Unknown
  Description of Unknown: Anti-microbial peptide
KFKKFKKFKKFKKFKKFKKFKKFKKFKKFKKFKKFK

SEQ ID NO: 2054 - protein, 23 aa, Unknown
  Description of Unknown: Anti-microbial peptide
VVRGACRAIRHIPRRIRGLERIL

SEQ ID NO: 2055 - protein, 7 aa, Unknown
  Description of Unknown: Anti-microbial peptide
HHQYNQR

SEQ ID NO: 2056 - protein, 18 aa, Unknown
  Description of Unknown: Anti-microbial peptide
KNLRRIIRKGIHIIKKYG

SEQ ID NO: 2057 - protein, 18 aa, Unknown
  Description of Unknown: Anti-microbial peptide
RHGSCNYVFPAHKCICYF

SEQ ID NO: 2058 - protein, 25 aa, Unknown
  Description of Unknown: Anti-microbial peptide
NQGRHFSGAALIHARFVMTAASCFQ

SEQ ID NO: 2059 - protein, 14 aa, Unknown
  Description of Unknown: Anti-microbial peptide
ILRWPWRRWPWRRK

SEQ ID NO: 2060 - protein, 51 aa, Unknown
  Description of Unknown: Anti-microbial peptide
QKLCQRPSGAWSGVCGNNNACKNQCIRLEKARHGSCNYVFPAHKCICYFPC

SEQ ID NO: 2061 - protein, 20 aa, Unknown
  Description of Unknown: Anti-microbial peptide
  MOD_RES (7)..(13): Any amino acid
KKWWRRXXXXXXXGPALSNV

SEQ ID NO: 2062 - protein, 16 aa, Unknown
  Description of Unknown: Anti-microbial peptide
NIRRIIRKIIHIIKKY

SEQ ID NO: 2063 - protein, 48 aa, Unknown
  Description of Unknown: Anti-microbial peptide
KFKKFKKFKKFKKFKKFKKFKKFKKFKKFKKFKKFKKFKKFKKFKKFK

SEQ ID NO: 2064 - protein, 9 aa, Unknown
  Description of Unknown: Anti-microbial peptide
RCLCGRGVC

SEQ ID NO: 2065 - protein, 23 aa, Unknown
  Description of Unknown: Anti-microbial peptide
VVQGICRAIRHIPRRIRGLERIL

SEQ ID NO: 2066 - protein, 7 aa, Unknown
  Description of Unknown: Anti-microbial peptide
HPQANQR

SEQ ID NO: 2067 - protein, 25 aa, Unknown
  Description of Unknown: Anti-microbial peptide
NQGRHFSAAALIHARFVMTAASCFQ

SEQ ID NO: 2068 - protein, 28 aa, Unknown
  Description of Unknown: Anti-microbial peptide
ILRWPWWPWRRKILMRWPWWPWRRKMAA

SEQ ID NO: 2069 - protein, 51 aa, Unknown
  Description of Unknown: Anti-microbial peptide
QKLCQRPSGTWSGVCGNNNACKNQCIRLEKARAGSCNYVFPAHKCICYFPC

SEQ ID NO: 2070 - protein, 7 aa, Unknown
  Description of Unknown: Anti-microbial peptide
  MOD_RES (7)..(7): Any amino acid
KKWWRRX

SEQ ID NO: 2071 - protein, 11 aa, Unknown
  Description of Unknown: Anti-microbial peptide
RRIIRKIIHII

SEQ ID NO: 2072 - protein, 23 aa, Unknown
  Description of Unknown: Anti-microbial peptide
GIGKFLHSAKKFGKAFVAEIMNS

SEQ ID NO: 2073 - protein, 63 aa, Unknown
  Description of Unknown: Anti-microbial peptide
KFKKFKKFKKFKKFKKFKKFKKFKKFKKFKKFKKFKKFKKFKKFKKFKKFKKFKKFKKFKKFK

SEQ ID NO: 2074 - protein, 9 aa, Unknown
  Description of Unknown: Anti-microbial peptide
RCLCGRGFC

SEQ ID NO: 2075 - protein, 23 aa, Unknown
  Description of Unknown: Anti-microbial peptide
VVQGACRAIRRIPRRIRGLERIL

SEQ ID NO: 2076 - protein, 7 aa, Unknown
  Description of Unknown: Anti-microbial peptide
HPQKNTY

SEQ ID NO: 2077 - protein, 18 aa, Unknown
  Description of Unknown: Anti-microbial peptide
KNLRRIIRKGIRIIKKYG

SEQ ID NO: 2078 - protein, 25 aa, Unknown
  Description of Unknown: Anti-microbial peptide
NQGRHFCAGALIHARFVMTAASSFQ

SEQ ID NO: 2079 - protein, 12 aa, Unknown
  Description of Unknown: Anti-microbial peptide
KRKWPWWPWRLI

SEQ ID NO: 2080 - protein, 51 aa, Unknown
  Description of Unknown: Anti-microbial peptide
QKLCQRPSGTWSGVCGNNNACKNQCIRLEKARHGSCNAVFPAHKCICYFPC

SEQ ID NO: 2081 - protein, 6 aa, Unknown
  Description of Unknown: Anti-microbial peptide
  MOD_RES (6)..(6): Any amino acid
KKWWKX

SEQ ID NO: 2082 - protein, 11 aa, Unknown
  Description of Unknown: Anti-microbial peptide
RIIRKIIHIIK

SEQ ID NO: 2083 - protein, 23 aa, Unknown
  Description of Unknown: Anti-microbial peptide
GIAKFLHSAKKFGKAFVAEIMNS

SEQ ID NO: 2084 - protein, 6 aa, Unknown
  Description of Unknown: Anti-microbial peptide
FKAFKA

SEQ ID NO: 2085 - protein, 9 aa, Unknown
  Description of Unknown: Anti-microbial peptide
RCICRRGVC

SEQ ID NO: 2086 - protein, 14 aa, Unknown
  Description of Unknown: Anti-microbial peptide
GACRAIRRIPRRIR

SEQ ID NO: 2087 - protein, 7 aa, Unknown
  Description of Unknown: Anti-microbial peptide
HPQFNQR

SEQ ID NO: 2088 - protein, 51 aa, Unknown; identical to SEQ ID NO: 606
  Description of Unknown: Anti-microbial peptide

SEQ ID NO: 2089 - protein, 25 aa, Unknown
  Description of Unknown: Anti-microbial peptide
NQGRHFCGAALIHARFVMTAASSFQ

SEQ ID NO: 2090 - protein, 12 aa, Unknown
  Description of Unknown: Anti-microbial peptide
ILKWVWWVWRRK

SEQ ID NO: 2091 - protein, 51 aa, Unknown
  Description of Unknown: Anti-microbial peptide
QKLCQRPSGTWSGVCGNNNACKNQCIRLEKARHGSCNYVAPAHKCICYFPC

SEQ ID NO: 2092 - protein, 8 aa, Unknown
  Description of Unknown: Anti-microbial peptide
KWKSFIKK

SEQ ID NO: 2093 - protein, 10 aa, Unknown
  Description of Unknown: Anti-microbial peptide
RIIRKIIHII

SEQ ID NO: 2094 - protein, 23 aa, Unknown
  Description of Unknown: Anti-microbial peptide
AAGKFLHSAKKFGKAFVGDIMNS

SEQ ID NO: 2095 - protein, 12 aa, Unknown
  Description of Unknown: Anti-microbial peptide
FKAFKAFKAFKA

SEQ ID NO: 2096 - protein, 9 aa, Unknown
  Description of Unknown: Anti-microbial peptide
RCICRRGFC

SEQ ID NO: 2097 - protein, 20 aa, Unknown
  Description of Unknown: Anti-microbial peptide
GACRAIRRIPRRIRGLERIL

SEQ ID NO: 2098 - protein, 7 aa, Unknown
  Description of Unknown: Anti-microbial peptide
HPNYNQR

SEQ ID NO: 2099 - protein, 13 aa, Unknown
  Description of Unknown: Anti-microbial peptide
FFKKWPWWPWRRK

SEQ ID NO: 2100 - protein, 18 aa, Unknown
  Description of Unknown: Anti-microbial peptide
KRLRRIIRKGIHIIKKYG

SEQ ID NO: 2101 - protein, 51 aa, Unknown; identical to SEQ ID NO: 611
  Description of Unknown: Anti-microbial peptide

SEQ ID NO: 2102 - protein, 25 aa, Unknown
  Description of Unknown: Anti-microbial peptide
NQGRHFCAAALIHARFVMTAASSFQ

SEQ ID NO: 2103 - protein, 13 aa, Unknown
  Description of Unknown: Anti-microbial peptide
ILKKWAWWPWRRK

SEQ ID NO: 2104 - protein, 50 aa, Unknown
  Description of Unknown: Anti-microbial peptide
QKLCQRSGTWSGVCGNNNACKNQCIRLEKARHGSCNYVFPAHKCICYFPC

SEQ ID NO: 2105 - protein, 24 aa, Unknown
  Description of Unknown: Anti-microbial peptide
  MOD_RES (7)..(9): Any amino acid
KKWWRRXXXGLKTAGPAIQSVLNK

SEQ ID NO: 2106 - protein, 22 aa, Unknown
  Description of Unknown: Anti-microbial peptide
GGKFLHSAKKFGKAFVGEIMNS

SEQ ID NO: 2107 - protein, 18 aa, Unknown
  Description of Unknown: Anti-microbial peptide
FKAFKAFKAFKAFKAFKA

SEQ ID NO: 2108 - protein, 9 aa, Unknown
  Description of Unknown: Anti-microbial peptide
RCICTRGVC

SEQ ID NO: 2109 - protein, 17 aa, Unknown
  Description of Unknown: Anti-microbial peptide
VVQRACRAIRHIPRRIR

SEQ ID NO: 2110 - protein, 7 aa, Unknown
  Description of Unknown: Anti-microbial peptide
HPEYNQR

SEQ ID NO: 2111 - protein, 13 aa, Unknown
  Description of Unknown: Anti-microbial peptide
FFKKFPFFPFRRK

SEQ ID NO: 2112 - protein, 50 aa, Unknown; identical to SEQ ID NO: 616
  Description of Unknown: Anti-microbial peptide

SEQ ID NO: 2113 - protein, 25 aa, Unknown
  Description of Unknown: Anti-microbial peptide
NQGRHFCGGALIHARFVMTAATCFQ

SEQ ID NO: 2114 - protein, 13 aa, Unknown
  Description of Unknown: Anti-microbial peptide
ILKKWPWWAWRRK

SEQ ID NO: 2115 - protein, 50 aa, Unknown
  Description of Unknown: Anti-microbial peptide
QKLCQRPSGTWSGVCGNNNACKNQCIRLEKARHGSCNYVPAHKCICYFPC

SEQ ID NO: 2116 - protein, 26 aa, Unknown
  Description of Unknown: Anti-microbial peptide
KWKLFKKIGIGAVLKVLTTGLPALIS

SEQ ID NO: 2117 - protein, 22 aa, Unknown
  Description of Unknown: Anti-microbial peptide
GGKFIHSAKKFGKAFVGEIMNS

SEQ ID NO: 2118 - protein, 21 aa, Unknown
  Description of Unknown: Anti-microbial peptide
FKAFKAFKAFKAFKAFKAFKA

SEQ ID NO: 2119 - protein, 9 aa, Unknown
  Description of Unknown: Anti-microbial peptide
RCICTRGFC

SEQ ID NO: 2120 - protein, 14 aa, Unknown
  Description of Unknown: Anti-microbial peptide
RACRAIRHIPRRIR

SEQ ID NO: 2121 - protein, 7 aa, Unknown
  Description of Unknown: Anti-microbial peptide
HPLYNQR

SEQ ID NO: 2122 - protein, 13 aa, Unknown
  Description of Unknown: Anti-microbial peptide
FFKKFPFFPFKKK

SEQ ID NO: 2123 - protein, 18 aa, Unknown
  Description of Unknown: Anti-microbial peptide
RRLRRIIRKGIRIIKKYG

SEQ ID NO: 2124 - protein, 51 aa, Unknown
  Description of Unknown: Anti-microbial peptide
QKLCERSSGTWSGVCGNNNACKNQCINLEGARHGSCNYIFPYHRCICYFPC

SEQ ID NO: 2125 - protein, 25 aa, Unknown
  Description of Unknown: Anti-microbial peptide
NQGRHFCGGALIHARFLMTAASCFQ

SEQ ID NO: 2126 - protein, 13 aa, Unknown
  Description of Unknown: Anti-microbial peptide
WWKKWPWWPWRRK

SEQ ID NO: 2127 - protein, 51 aa, Unknown
  Description of Unknown: Anti-microbial peptide
QKLCQRRSGTWSGVCGNNNACKNQCIRLEKARHGSCNYVFPAHKCICYFPC

SEQ ID NO: 2128 - protein, 114 aa, Unknown
  Description of Unknown: Anti-microbial peptide
MVTKVICFLVLASVLLAVAFPVSALRQQVKKGGGGEGGGGGSVSGSGGGNLNPWECSPKCGSRCSKTQYRKACLTLCNKCCAKCLCVPPGFYGNKGACPCYNNWKTKEGGPKCP

SEQ ID NO: 2129 - protein, 28 aa, Unknown
  Description of Unknown: Anti-microbial peptide
KWKLFKKIGIGAVLKVLTTGLPALKKTK

SEQ ID NO: 2130 - protein, 24 aa, Unknown
  Description of Unknown: Anti-microbial peptide
GIGKFIHSAKKFGKAFVGEIMNSK

SEQ ID NO: 2131 - protein, 24 aa, Unknown
  Description of Unknown: Anti-microbial peptide
FKAFKAFKAFKAFKAFKAFKAFKA

SEQ ID NO: 2132 - protein, 114 aa, Unknown; identical to SEQ ID NO: 2128
  Description of Unknown: Anti-microbial peptide

SEQ ID NO: 2133 - protein, 9 aa, Unknown
  Description of Unknown: Anti-microbial peptide
RCICTLGIC

SEQ ID NO: 2134 - protein, 13 aa, Unknown
  Description of Unknown: Anti-microbial peptide
RPGLTLCTVAGWG

SEQ ID NO: 2135 - protein, 16 aa, Unknown
  Description of Unknown: Anti-microbial peptide
ILKKWPWWPWWPWRRK

SEQ ID NO: 2136 - protein, 25 aa, Unknown
  Description of Unknown: Anti-microbial peptide
NQGRHFCGGALIHARFIMTAASCFQ

SEQ ID NO: 2137 - protein, 14 aa, Unknown
  Description of Unknown: Anti-microbial peptide
  MOD_RES (7)..(7): Any amino acid
YAERLCXCSIKAEV

SEQ ID NO: 2138 - protein, 12 aa, Unknown
  Description of Unknown: Anti-microbial peptide
LKKWPWWPWRRK

SEQ ID NO: 2139 - protein, 51 aa, Unknown
  Description of Unknown: Anti-microbial peptide
QKLCQRPSRTWSGVCGNNNACKNQCIRLEKARHGSCNYVFPAHKCICYFPC

SEQ ID NO: 2140 - protein, 95 aa, Unknown
  Description of Unknown: Anti-microbial peptide
MKLQATARVAGLLFLVLLLALPSLRVSMAGSGFCDGKCAVRCSKASRHDDCLKYCGICCATCNCVPSGTAGNKDECPCYRDMTTGHGNRTRPKCP

SEQ ID NO: 2141 - protein, 25 aa, Unknown
  Description of Unknown: Anti-microbial peptide
  MOD_RES (7)..(7): Any amino acid
  MOD_RES (9)..(10): Any amino acid
  MOD_RES (12)..(14): Any amino acid
  MOD_RES (18)..(19): Any amino acid
  MOD_RES (21)..(21): Any amino acid
  MOD_RES (23)..(25): Any amino acid
KKWWRRXLXXLXXXGPAXXSXVXXX

SEQ ID NO: 2142 - protein, 27 aa, Unknown
  Description of Unknown: Anti-microbial peptide
FKAFKAFKAFKAFKAFKAFKAFKAFKA

SEQ ID NO: 2143 - protein, 95 aa, Unknown; identical to SEQ ID NO: 2140
  Description of Unknown: Anti-microbial peptide

SEQ ID NO: 2144 - protein, 21 aa, Unknown
  Description of Unknown: Anti-microbial peptide
RVIRVVRGACRAIRHIPRRIR

SEQ ID NO: 2145 - protein, 15 aa, Unknown
  Description of Unknown: Anti-microbial peptide
CTVAGWGRVSMRRGT

SEQ ID NO: 2146 - protein, 15 aa, Unknown
  Description of Unknown: Anti-microbial peptide
ILKKWPWWPWRWWRR

SEQ ID NO: 2147 - protein, 25 aa, Unknown
  Description of Unknown: Anti-microbial peptide
NQGRHFCGGALIHARFAMTAASCFQ

SEQ ID NO: 2148 - protein, 14 aa, Unknown
  Description of Unknown: Anti-microbial peptide
ALYKKKIIKKLLES

SEQ ID NO: 2149 - protein, 8 aa, Unknown
  Description of Unknown: Anti-microbial peptide
PWWPWRRK

SEQ ID NO: 2150 - protein, 51 aa, Unknown
  Description of Unknown: Anti-microbial peptide
QKLCQRPSGTWRGVCGNNNACKNQCIRLEKARHGSCNYVFPAHKCICYFPC

SEQ ID NO: 2151 - protein, 115 aa, Unknown
  Description of Unknown: Anti-microbial peptide
MAPSKLAVVVALVASLLLLTTSNTKLGLFVLGQAAPGAYPPRAPPPHQIVDLAKDCGGACDVRCGAHSRKNICTRACLKCCGVCRCVPAGTAGNQQTCGKCYTDWTTHGNKTKCP

SEQ ID NO: 2152 - protein, 23 aa, Unknown
  Description of Unknown: Anti-microbial peptide
  MOD_RES (6)..(8): Any amino acid
  MOD_RES (10)..(11): Any amino acid
  MOD_RES (15)..(17): Any amino acid
  MOD_RES (23)..(23): Any amino acid
KKWWKXXXKXXNSGXXXLQTLAX

SEQ ID NO: 2153 - protein, 46 aa, Unknown
  Description of Unknown: Anti-microbial peptide
LRLLTPSQFTRIGLTVAKKNVRRAHERNRIKRLTRELDFVVLSEAL

SEQ ID NO: 2154 - protein, 5 aa, Unknown
  Description of Unknown: Anti-microbial peptide
  MOD_RES (2)..(5): Any amino acid
AXXXX

SEQ ID NO: 2155 - protein, 30 aa, Unknown
  Description of Unknown: Anti-microbial peptide
FKAFKAFKAFKAFKAFKAFKAFKAFKAFKA

SEQ ID NO: 2156 - protein, 115 aa, Unknown; identical to SEQ ID NO: 2151
  Description of Unknown: Anti-microbial peptide

SEQ ID NO: 2157 - protein, 9 aa, Unknown
  Description of Unknown: Anti-microbial peptide
RCICRLGIC

SEQ ID NO: 2158 - protein, 23 aa, Unknown
  Description of Unknown: Anti-microbial peptide
GIGKFLHSAKKFAKAFVAEIMNS

SEQ ID NO: 2159 - protein, 4 aa, Unknown
  Description of Unknown: Anti-microbial peptide
  MOD_RES (1)..(4): Any amino acid
XXXX

SEQ ID NO: 2160 - protein, 40 aa, Unknown
  Description of Unknown: Anti-microbial peptide
QRAVKKIEKAIKHIPKKIKIRALAGPGVTIGIAHAKSQLW

SEQ ID NO: 2161 - protein, 25 aa, Unknown
  Description of Unknown: Anti-microbial peptide
FLIRQLIRLLTWLFSNCRTLLSRVY

SEQ ID NO: 2162 - protein, 37 aa, Unknown
  Description of Unknown: Anti-microbial peptide
GFFKKAWRKVKHAGRRVLDTAKGVGRHYVNNWLNRYR

SEQ ID NO: 2163 - protein, 7 aa, Unknown
  Description of Unknown: Anti-microbial peptide
  MOD_RES (2)..(7): Any amino acid
HXXXXXX

SEQ ID NO: 2164 - protein, 17 aa, Unknown
  Description of Unknown: Anti-microbial peptide
ASRAAGLAARLARLALR

SEQ ID NO: 2165 - protein, 14 aa, Unknown
  Description of Unknown: Anti-microbial peptide
ILPWKKWPWWRWRR

SEQ ID NO: 2166 - protein, 41 aa, Unknown; identical to SEQ ID NO: 25
  Description of Unknown: Anti-microbial peptide

SEQ ID NO: 2167 - protein, 74 aa, Unknown
  Description of Unknown: Anti-microbial peptide
MAGFSKVVATIFLMMKVFATDMMAEAKICEALSGNFKGLCLSSRDCGNVCRREGFTDGSCIGFRLQCFCTKPCA

SEQ ID NO: 2168 - protein, 36 aa, Unknown
  Description of Unknown: Anti-microbial peptide
DHYNCVSSGGQCLYSACPIFTKIQGTCYRGKAKCCK

SEQ ID NO: 2169 - protein, 9 aa, Unknown
  Description of Unknown: Anti-microbial peptide
ALLLAIRKR

SEQ ID NO: 2170 - protein, 18 aa, Unknown
  Description of Unknown: Anti-microbial peptide
KNLRRTIRKIIHIIKKYG

SEQ ID NO: 2171 - protein, 15 aa, Unknown
  Description of Unknown: Anti-microbial peptide
HGSCNYVFPAHKCIC

SEQ ID NO: 2172 - protein, 19 aa, Unknown
  Description of Unknown: Anti-microbial peptide
GKWKLFKKAFKKFLKILAG

SEQ ID NO: 2173 - protein, 14 aa, Unknown
  Description of Unknown: Anti-microbial peptide
KRLFKELLKSLRKY

SEQ ID NO: 2174 - protein, 79 aa, Unknown
  Description of Unknown: Anti-microbial peptide
MRLVVCLVFLASFALVCQGQVYKGGYTRPIPRPPPFVRPLPGGPIGPYNGCPVSCRGISFSQARSCCSRLGRCCHVGKG

SEQ ID NO: 2175 - protein, 20 aa, Unknown
  Description of Unknown: Anti-microbial peptide
RHFSGGALIHARFVMTAASC

SEQ ID NO: 2176 - protein, 10 aa, Unknown
  Description of Unknown: Anti-microbial peptide
NVGFYEKCGY

SEQ ID NO: 2177 - protein, 13 aa, Unknown
  Description of Unknown: Anti-microbial peptide
ARYKKFKKKLLKS

SEQ ID NO: 2178 - protein, 18 aa, Unknown
  Description of Unknown: Anti-microbial peptide
RRWCFRVCYKGFCRYKCR

SEQ ID NO: 2179 - protein, 44 aa, Unknown
  Description of Unknown: Anti-microbial peptide
  MOD_RES (20)..(20): Any amino acid
FFRHLFRGAKAIFRGARQGXRAHKVVSRYRNRDVPETDNNQEEP

SEQ ID NO: 2180 - protein, 20 aa, Unknown
  Description of Unknown: Anti-microbial peptide
LAHQKPFIRKSYKCLHKRCR

SEQ ID NO: 2181 - protein, 26 aa, Unknown
  Description of Unknown: Anti-microbial peptide
KWKSFIKKLTKAAKKVVTTAKKPLIV

SEQ ID NO: 2182 - protein, 5 aa, Unknown
  Description of Unknown: Anti-microbial peptide
YAELR

SEQ ID NO: 2183 - protein, 22 aa, Unknown
  Description of Unknown: Anti-microbial peptide
GIGKFLKKAKKFGKAFVKILKK

SEQ ID NO: 2184 - protein, 12 aa, Unknown
  Description of Unknown: Anti-microbial peptide
KVAKQEKKKKKT

SEQ ID NO: 2185 - protein, 12 aa, Unknown
  Description of Unknown: Anti-microbial peptide
RVVRVVRRVVRR

SEQ ID NO: 2186 - protein, 26 aa, Unknown
  Description of Unknown: Anti-microbial peptide
KWKKFIKNLTKGGSKILTTGLPALIS

SEQ ID NO: 2187 - protein, 96 aa, Unknown
  Description of Unknown: Anti-microbial peptide
MKATMLLAVVVAVFVAGTEAHPHVCTSYYCSKFCGTAGCTRYGCRNLHRGKLCFCLHCSRVKFPFGATQDAKSMNELEYTPIMKSMENLDNGMDML

SEQ ID NO: 2188 - protein, 20 aa, Unknown
  Description of Unknown: Anti-microbial peptide
LGRKIAHGVKKYGPTVLRII

SEQ ID NO: 2189 - protein, 16 aa, Unknown
  Description of Unknown: Anti-microbial peptide
DGPKKKKKKSPSKSSG

SEQ ID NO: 2190 - protein, 18 aa, Unknown
  Description of Unknown: Anti-microbial peptide
GICRCICGRGICRCYCGR

SEQ ID NO: 2191 - protein, 17 aa, Unknown
  Description of Unknown: Anti-microbial peptide
RRIRHIPRAIRVVQGAC

SEQ ID NO: 2192 - protein, 10 aa, Unknown
  Description of Unknown: Anti-microbial peptide
WGRVSMRRGT

SEQ ID NO: 2193 - protein, 15 aa, Unknown
  Description of Unknown: Anti-microbial peptide
ILKKWPWWPWRRWWK

SEQ ID NO: 2194 - protein, 30 aa, Unknown
  Description of Unknown: Anti-microbial peptide
QKLCERPSGTWSGVCGNNNACKNQCINLEK

SEQ ID NO: 2195 - protein, 25 aa, Unknown
  Description of Unknown: Anti-microbial peptide
NQGRHYCGGALIHARFVMTAASCFQ

SEQ ID NO: 2196 - protein, 21 aa, Unknown
  Description of Unknown: Anti-microbial peptide
ILKKWPWWPWRRKMILKKAGS

SEQ ID NO: 2197 - protein, 51 aa, Unknown
  Description of Unknown: Anti-microbial peptide
QKLCQRPSGTWSGVCGNNNACKNQCRRLEKARHGSCNYVFPAHKCICYFPC

SEQ ID NO: 2198 - protein, 100 aa, Unknown
  Description of Unknown: Anti-microbial peptide
MAVAKPPLQTAAVLLLLLLVVAAASWLQTVDAASGFCSSKCSVRCGRAASARARGACMRSCGLCCEECNCVPTRPPRDVNECPCYRDMLTAGPRKRPKCP

SEQ ID NO: 2199 - protein, 46 aa, Unknown
  Description of Unknown: Anti-microbial peptide
LRLLTPKHFNRIGLTIAKKNVKRAHERNRIKRLARELDFVVLTEVL

SEQ ID NO: 2200 - protein, 51 aa, Unknown
  Description of Unknown: Anti-microbial peptide
FKAFKAFKAFKAFKAFKAFKAFKAFKAFKAFKAFKAFKAFKAFKAFKAFKA

SEQ ID NO: 2201 - protein, 100 aa, Unknown; identical to SEQ ID NO: 2198
  Description of Unknown: Anti-microbial peptide

SEQ ID NO: 2202 - protein, 9 aa, Unknown
  Description of Unknown: Anti-microbial peptide
RCICVRGVC

SEQ ID NO: 2203 - protein, 223 aa, Unknown
  Description of Unknown: Anti-microbial peptide
IIGGRESRPHSRPYMAYLQIQSPAGQSRCGGFLVREDFVLTAAHCWGSNINVTLGAHNIDRRENTQQHITARRAIRHPQYNQRTIQNDIMLLQLSRRVRRNRNVNPVALPRAQEGLRPGTLCTVAGWGRVSMRRGTDTLREVQLRVQRDRQCLRIFGSYDPRRQICVGDRRERKAAFKGDSGGPLLCNNVAHGIVSYGKSSGVPPEVFTRVSSFLPWIRTTMR

SEQ ID NO: 2204 - protein, 223 aa, Unknown; identical to SEQ ID NO: 2203
  Description of Unknown: Anti-microbial peptide

SEQ ID NO: 2205 - protein, 15 aa, Unknown
  Description of Unknown: Anti-microbial peptide
ILKKWPWWPWPPRRK

SEQ ID NO: 2206 - protein, 25 aa, Unknown
  Description of Unknown: Anti-microbial peptide
NQGRHFCGGALIHARYVMTAASCFQ

SEQ ID NO: 2207 - protein, 23 aa, Unknown
  Description of Unknown: Anti-microbial peptide
QKLCERPSGTWSGVCGNNNACKN

SEQ ID NO: 2208 - protein, 20 aa, Unknown
  Description of Unknown: Anti-microbial peptide
ILKKWPWWPWRRMILKKAGS

SEQ ID NO: 2209 - protein, 51 aa, Unknown
  Description of Unknown: Anti-microbial peptide
QKLCQRPSGTWSGVCGNNNACKNQCIRREKARHGSCNYVFPAHKCICYFPC

SEQ ID NO: 2210 - protein, 128 aa, Unknown
  Description of Unknown: Anti-microbial peptide
MMTTMKKKKQQQQLLLLSLMFLVAVTAAAVAADPHPQQVQVQQQQQAQMRINRATRSLLPQPPPKLDCPSTCSVRCGNNWKNQMCNKMCNVCCNKCSCVPPGTGQDTRHLCPCYDTMLNPHTGKLKCP

SEQ ID NO: 2211 - protein, 46 aa, Unknown
  Description of Unknown: Anti-microbial peptide
LRLLTPIQFKRLGLTVAKKHLKRAHERNRIKRLVRELDFVFFAQIL

SEQ ID NO: 2212 - protein, 63 aa, Unknown
  Description of Unknown: Anti-microbial peptide
FKAFKAFKAFKAFKAFKAFKAFKAFKAFKAFKAFKAFKAFKAFKAFKAFKAFKAFKAFKAFKA

SEQ ID NO: 2213 - protein, 128 aa, Unknown; identical to SEQ ID NO: 2210
  Description of Unknown: Anti-microbial peptide

SEQ ID NO: 2214 - protein, 9 aa, Unknown
  Description of Unknown: Anti-microbial peptide
RCICGRGFC

SEQ ID NO: 2215 - protein, 28 aa, Unknown
  Description of Unknown: Anti-microbial peptide
LIRELGQRIRRPIHRIARCAGQVVEIVR

SEQ ID NO: 2216 - protein, 20 aa, Unknown
  Description of Unknown: Anti-microbial peptide
KPGQTCSVAGWGQTAPLGKS

SEQ ID NO: 2217 - protein, 17 aa, Unknown
  Description of Unknown: Anti-microbial peptide
ILKKWPWWPWPPFFRRK

SEQ ID NO: 2218 - protein, 25 aa, Unknown
  Description of Unknown: Anti-microbial peptide
QKLCERPSGTWSGVCGNNNACKNQC

SEQ ID NO: 2219 - protein, 25 aa, Unknown
  Description of Unknown: Anti-microbial peptide
NQGRHFCGGALIHARFVMTAASCYQ

SEQ ID NO: 2220 - protein, 21 aa, Unknown
  Description of Unknown: Anti-microbial peptide
ILKKWPWWPWRRIMILKKAGS

SEQ ID NO: 2221 - protein, 51 aa, Unknown
  Description of Unknown: Anti-microbial peptide
QKLCQRPSGTWSGVCGNNNACKNQCIRLEKARHGSCRYVFPAHKCICYFPC

SEQ ID NO: 2222 - protein, 96 aa, Unknown
  Description of Unknown: Anti-microbial peptide
MKAIPVALLLLVLVAAASSFKHLAEAADGGAVPDGVCDGKCRSRCSLKKAGRCMGLCMMCCGKCQGCVPSGPYASKDECPCYRDMKSPKNQRPKCP

SEQ ID NO: 2223 - protein, 46 aa, Unknown
  Description of Unknown: Anti-microbial peptide
KRLLTPRHFKRLGLVIGKKSVKLAVQRNRLKRLMRDLDIVILHQHF

SEQ ID NO: 2224 - protein, 4 aa, Unknown
  Description of Unknown: Anti-microbial peptide
LKLK

SEQ ID NO: 2225 - protein, 96 aa, Unknown; identical to SEQ ID NO: 2222
  Description of Unknown: Anti-microbial peptide

SEQ ID NO: 2226 - protein, 9 aa, Unknown
  Description of Unknown: Anti-microbial peptide
RCICGLGFC

SEQ ID NO: 2227 - protein, 28 aa, Unknown
  Description of Unknown: Anti-microbial peptide
LIRELGQRIRRPIHRIARCAGQVVRIVR

SEQ ID NO: 2228 - protein, 20 aa, Unknown
  Description of Unknown: Anti-microbial peptide
KPQDVCYVAGWGRMAPMGKY

SEQ ID NO: 2229 - protein, 26 aa, Unknown
  Description of Unknown: Anti-microbial peptide
QKLCQRPSGTWSGVCGNNNACRNQCI

SEQ ID NO: 2230 - protein, 20 aa, Unknown
  Description of Unknown: Anti-microbial peptide
RHFSAGALIHARFVMTAASC

SEQ ID NO: 2231 - protein, 7 aa, Unknown
  Description of Unknown: Anti-microbial peptide
WWPWRRK

SEQ ID NO: 2232 - protein, 51 aa, Unknown
  Description of Unknown: Anti-microbial peptide
QKLCQRPSGTWSGVCGNNNACKNQCIRLEKARHGSCNYRFPAHKCICYFPC

SEQ ID NO: 2233 - protein, 46 aa, Unknown
  Description of Unknown: Anti-microbial peptide
SKLLKSTNFQRLGLSISRKNIKHAYRRNKIKRLIRELDFVVIVNIL

SEQ ID NO: 2234 - protein, 10 aa, Unknown
  Description of Unknown: Anti-microbial peptide
LKLKLKLKLK

SEQ ID NO: 2235 - protein, 9 aa, Unknown
  Description of Unknown: Anti-microbial peptide
RCICGLGVC

SEQ ID NO: 2236 - protein, 28 aa, Unknown
  Description of Unknown: Anti-microbial peptide
LIRELGQRIRRPIHRIARCAGRVVEIVR

SEQ ID NO: 2237 - protein, 20 aa, Unknown
  Description of Unknown: Anti-microbial peptide
EAQTRCQVAGWGSQSRSGGR

SEQ ID NO: 2238 - protein, 27 aa, Unknown
  Description of Unknown: Anti-microbial peptide
QKLCERPSGTWSGVCGNSNACKNQCIN

SEQ ID NO: 2239 - protein, 20 aa, Unknown
  Description of Unknown: Anti-microbial peptide
RHFSGAALIHARFVMTAASC

SEQ ID NO: 2240 - protein, 7 aa, Unknown
  Description of Unknown: Anti-microbial peptide
ILKKWPW

SEQ ID NO: 2241 - protein, 51 aa, Unknown
  Description of Unknown: Anti-microbial peptide
QKLCQRPSGTWSGVCGNNNACKNQCIRLEKARHGSCNYVFPRHKCICYFPC

SEQ ID NO: 2242 - protein, 94 aa, Unknown
  Description of Unknown: Anti-microbial peptide
MAKASSRLLFSLSLVVLLLLVETTTSPHGQADAIDCGASCSYRCSKSGRPKMCLRACGTCCQRCGCVPPGTSGNEDVCPCYANMKTHDGQHKCP

SEQ ID NO: 2243 - protein, 46 aa, Unknown
  Description of Unknown: Anti-microbial peptide
  MOD_RES (28)..(28): Any amino acid
LRLLTPAHFTRIGLTVAKKNVRRAHERXRIKRLTRELDFVVLSEAL

SEQ ID NO: 2244 - protein, 16 aa, Unknown
  Description of Unknown: Anti-microbial peptide
LKLKLKLKLKLKLKLK

SEQ ID NO: 2245 - protein, 94 aa, Unknown; identical to SEQ ID NO: 2242
  Description of Unknown: Anti-microbial peptide

SEQ ID NO: 2246 - protein, 9 aa, Unknown
  Description of Unknown: Anti-microbial peptide
RCLCRLGIC

SEQ ID NO: 2247 - protein, 28 aa, Unknown
  Description of Unknown: Anti-microbial peptide
LIRELGQRIRRPIHRIARCIGQVVEIVR

SEQ ID NO: 2248 - protein, 20 aa, Unknown
  Description of Unknown: Anti-microbial peptide
GNGVQCLAMGWGLLGRNRGI

SEQ ID NO: 2249 - protein, 20 aa, Unknown
  Description of Unknown: Anti-microbial peptide
RHFSAAALIHARFVMTAASC

SEQ ID NO: 2250 - protein, 14 aa, Unknown
  Description of Unknown: Anti-microbial peptide
ILKKWPWWPWRRKM

SEQ ID NO: 2251 - protein, 51 aa, Unknown
  Description of Unknown: Anti-microbial peptide
QKLCQRPSGTWSGVCGNNNACKNQCIRLEKARHGSCNYVFPAHKCRCYFPC

SEQ ID NO: 2252 - protein, 145 aa, Unknown
  Description of Unknown: Anti-microbial peptide
MESKSPWSLRLLICCAAMVAIALLPQQGGQAACFVPTPGPAPAPPGSSATNTNASSAAPRPAKPSAFPPPMYGGVTPGTGSLQPHECGGRCAERCSATAYQKPCLFFCRKCCAACLCVPPGTYGNKNTCPCYNNWKTKRGGPKCP

SEQ ID NO: 2253 - protein, 46 aa, Unknown
  Description of Unknown: Anti-microbial peptide
LRLLTPSHFTRIGLTVAKKHVKRAHERNRIKRLTRELDFVVLTEAL

SEQ ID NO: 2254 - protein, 18 aa, Unknown
  Description of Unknown: Anti-microbial peptide
LKLKLKLKLKLKLKLKLK

SEQ ID NO: 2255 - protein, 215 aa, Unknown
  Description of Unknown: Anti-microbial peptide
MESKSPWSLRLLICCAAMVAIALLPQQGGQAACFVPTPGPAPAPPGSSATNTNASSAAPRPAKPSAFPPPMYGGVTPGTGSLQPHECGGRCAERCSATAYQKPCLFFCRKCCAACLCVPPGTYGNKNTCPCYNNWKTKRGMYGGVTPGTGSLQPHECGGRCAERCSATAYQKPCLFFCRKCCAACLCVPPGTYGNKNTCPCYNNWKTKRGGPKCP

SEQ ID NO: 2256 - protein, 9 aa, Unknown
  Description of Unknown: Anti-microbial peptide
RCLCRRGVC

SEQ ID NO: 2257 - protein, 28 aa, Unknown
  Description of Unknown: Anti-microbial peptide
LIRELGQRIRRPIRRIARCAGQVVEIVR

SEQ ID NO: 2258 - protein, 20 aa, Unknown [sequence omitted]

SEQ ID NO: 2259 - protein, 15 aa, Unknown
  Description of Unknown: Anti-microbial peptide
QKLCQRPSGTWSGVC

SEQ ID NO: 2260 - protein, 20 aa, Unknown
  Description of Unknown: Anti-microbial peptide
RHFSGGALIHARFLMTAASC

SEQ ID NO: 2261 - protein, 51 aa, Unknown
  Description of Unknown: Anti-microbial peptide
QKLCQRPSGTWSGVCGNNNACKNQCIRLEKARHGSCNYVFPAHKCICYRPC

SEQ ID NO: 2262 - protein, 46 aa, Unknown
  Description of Unknown: Anti-microbial peptide
LRLLTPSHFTRIGLTVAKKNVKRAHERNRIKRLTRELDFVVLSEAL

SEQ ID NO: 2263 - protein, 20 aa, Unknown
  Description of Unknown: Anti-microbial peptide
LKLKLKLKLKLKLKLKLKLK

SEQ ID NO: 2264 - protein, 77 aa, Unknown
  Description of Unknown: Anti-microbial peptide
MGGGNGGAGGGGKLKPWECSSKCSSRCSGTQYKKACLTYCNKCCATCLCVPPGTYGNKGACPCYNNWKTKEGGPKCP

SEQ ID NO: 2265 - protein, 9 aa, Unknown
  Description of Unknown: Anti-microbial peptide
RCLCRRGFC

SEQ ID NO: 2266 - protein, 28 aa, Unknown
  Description of Unknown: Anti-microbial peptide
LIRELGIRIRRPIHRIARCAGQVVEIVR

SEQ ID NO: 2267 - protein, 20 aa, Unknown
  Description of Unknown: Anti-microbial peptide
AAGTTCVTTGWGLTRYTNAN

SEQ ID NO: 2268 - protein, 15 aa, Unknown
  Description of Unknown: Anti-microbial peptide
QRPSGTWSGVCGNNN

SEQ ID NO: 2269 - protein, 20 aa, Unknown
  Description of Unknown: Anti-microbial peptide
RHFSGGALIHARFIMTAASC

SEQ ID NO: 2270 - protein, 14 aa, Unknown
  Description of Unknown: Anti-microbial peptide
ILKKWPWWPWRRIM

SEQ ID NO: 2271 - protein, 94 aa, Unknown
  Description of Unknown: Anti-microbial peptide
MKKLRTTTLALLLLLVFLAASSLRAAMAGSAFCDGKCGVRCSKASRHDDCLKYCGICCAECNCVPSGTAGNKDECPCYRDKTTGHGARKRPKCP

SEQ ID NO: 2272 - protein, 44 aa, Unknown
  Description of Unknown: Anti-microbial peptide
IRLPATSTRIGLTVAKKNVRRAHERNRIKRLTRELDFVVLSEAL

SEQ ID NO: 2273 - protein, 22 aa, Unknown
  Description of Unknown: Anti-microbial peptide
LKLKLKLKLKLKLKLKLKLKLK

SEQ ID NO: 2274 - protein, 94 aa, Unknown; identical to SEQ ID NO: 2271
  Description of Unknown: Anti-microbial peptide

SEQ ID NO: 2275 - protein, 28 aa, Unknown
  Description of Unknown: Anti-microbial peptide
LIRRLGQRIRRPIHRIARCAGQVVEIVR

SEQ ID NO: 2276 - protein, 21 aa, Unknown
  Description of Unknown: Anti-microbial peptide
GIGKFLHSAKKFKAFVGEIMN

SEQ ID NO: 2277 - protein, 15 aa, Unknown
  Description of Unknown: Anti-microbial peptide
GTWSGVCGNNNACKN

SEQ ID NO: 2278 - protein, 20 aa, Unknown
  Description of Unknown: Anti-microbial peptide
RHFSGGALIHARFAMTAASC

SEQ ID NO: 2279 - protein, 11 aa, Unknown
  Description of Unknown: Anti-microbial peptide
ILKKWWWPWRK

SEQ ID NO: 2280 - protein, 98 aa, Unknown
  Description of Unknown: Anti-microbial peptide
MKKLRTTTATTTLALILLLVLIAATSLRVAMAGSAFCDSKCGVRCSKAGRHDDCLKYCGICCAECNCVPSGTAGNKDECPCYRDKTTGHGARTRPKCP

SEQ ID NO: 2281 - protein, 46 aa, Unknown
  Description of Unknown: Anti-microbial peptide
LRLLTPEHYQRLGLAVPKKQIKTAVGRNRFKRICRELDFVVLFNLL

SEQ ID NO: 2282 - protein, 24 aa, Unknown
  Description of Unknown: Anti-microbial peptide
LKLKLKLKLKLKLKLKLKLKLKLK

SEQ ID NO: 2283 - protein, 98 aa, Unknown; identical to SEQ ID NO: 2280
  Description of Unknown: Anti-microbial peptide

SEQ ID NO: 2284 - protein, 9 aa, Unknown
  Description of Unknown: Anti-microbial peptide
RCLCTRGVC

SEQ ID NO: 2285 - protein, 21 aa, Unknown
  Description of Unknown: Anti-microbial peptide
RIRRPIHRIARCAGQVVEIVR

SEQ ID NO: 2286 - protein, 7 aa, Unknown
  Description of Unknown: Anti-microbial peptide
HPQYNPK

SEQ ID NO: 2287 - protein, 15 aa, Unknown
  Description of Unknown: Anti-microbial peptide
GVCGNNNACKNQCIR

SEQ ID NO: 2288 - protein, 20 aa, Unknown
  Description of Unknown: Anti-microbial peptide
RHYSGGALIHARFVMTAASC

SEQ ID NO: 2289 - protein, 11 aa, Unknown
  Description of Unknown: Anti-microbial peptide
ILKKWPWWWRK

SEQ ID NO: 2290 - protein, 107 aa, Unknown
  Description of Unknown: Anti-microbial peptide
MKPLPVTLALLALFLVASYQDLTVAADADADAAGAGDVGAVPVPDSVCEGKCKNRCSQKVAGRCMGLCMMCCGKCAGCVPSGPLAPKDECPCYRDMKSPKSGRPKCP

SEQ ID NO: 2291 - protein, 46 aa, Unknown
  Description of Unknown: Anti-microbial peptide
KRLLTARQFSRLGLVIGKKNVKLAVQRNRLKRLIRELDIVVLHQQF

SEQ ID NO: 2292 - protein, 36 aa, Unknown
  Description of Unknown: Anti-microbial peptide
LKLKLKLKLKLKLKLKLKLKLKLKLKLKLKLKLKLK

SEQ ID NO: 2293 - protein, 107 aa, Unknown; identical to SEQ ID NO: 2290
  Description of Unknown: Anti-microbial peptide

SEQ ID NO: 2294 - protein, 9 aa, Unknown
  Description of Unknown: Anti-microbial peptide
RCLCTRGFC

SEQ ID NO: 2295 - protein, 24 aa, Unknown
  Description of Unknown: Anti-microbial peptide
IGKFLHSAKKFAKAFAFVAEIMNS

SEQ ID NO: 2296 - protein, 5 aa, Unknown
  Description of Unknown: Anti-microbial peptide
  MOD_RES (1)..(5): Any amino acid
XXXXX

SEQ ID NO: 2297 - protein, 40 aa, Unknown
  Description of Unknown: Anti-microbial peptide
IQRVAQKLKKALRALARHWKRALAGPGVTIGIAHAKSQLW

SEQ ID NO: 2298 - protein, 28 aa, Unknown
  Description of Unknown: Anti-microbial peptide
LLSRVYQILQPILQRLSATLQRIREVLR

SEQ ID NO: 2299 - protein, 7 aa, Unknown
  Description of Unknown: Anti-microbial peptide
HPAYNPK

SEQ ID NO: 2300 - protein, 18 aa, Unknown
  Description of Unknown: Anti-microbial peptide
MVSRAAGLAARLARLALR

SEQ ID NO: 2301 - protein, 80 aa, Unknown
  Description of Unknown: Anti-microbial peptide
MKTTILILLILGLGINAKSLEERKSEEEKVFHLLGKIIHHVGNFVYGFSHVFGDDQQDNGKFYGHYAEDNGKHWYDTGDQ

SEQ ID NO: 2302 - protein, 40 aa, Unknown; identical to SEQ ID NO: 26
  Description of Unknown: Anti-microbial peptide

SEQ ID NO: 2303 - protein, 9 aa, Unknown
  Description of Unknown: Anti-microbial peptide
AWLLAIRKR

SEQ ID NO: 2304 - protein, 18 aa, Unknown
  Description of Unknown: Anti-microbial peptide
KNLRRSIRKIIHIIKKYG

SEQ ID NO: 2305 - protein, 10 aa, Unknown
  Description of Unknown: Anti-microbial peptide
CNYVFPAHKC

SEQ ID NO: 2306 - protein, 29 aa, Unknown
  Description of Unknown: Anti-microbial peptide
CGGGGGGGGGKWKAFKKAFKKFAKILACG

SEQ ID NO: 2307 - protein, 14 aa, Unknown
  Description of Unknown: Anti-microbial peptide
  MOD_RES (1)..(2): Any amino acid
  MOD_RES (5)..(5): Any amino acid
  MOD_RES (8)..(9): Any amino acid
  MOD_RES (12)..(13): Any amino acid
XXLFXELXXSLXXY

SEQ ID NO: 2308 - protein, 50 aa, Unknown
  Description of Unknown: Anti-microbial peptide
YRGGYTGPIPRPPPIGRPPLRLVVCACYRLSVSDARNCCIKFGSCCHLVK

SEQ ID NO: 2309 - protein, 165 aa, Unknown
  Description of Unknown: Anti-microbial peptide
MKFACALLALLGLATSCSFIVFRSEWRALPSECSSRLGHPVRYVVISHTRGSFCNSFDSCEQQARNVQHYHKNELEWCDVAYNIKEDHTEPIYNPMSIGITFMGNFMDRVRKAALRAALNLLESGVSRGFLRSNYEVKGHRDVQSFLSFGDQKYQVIQSWEHYRE

SEQ ID NO: 2310 - protein, 25 aa, Unknown
  Description of Unknown: Anti-microbial peptide
NQGRHFCGGALIHARFVMTAASSFQ

SEQ ID NO: 2311 - protein, 23 aa, Unknown
  Description of Unknown: Anti-microbial peptide
IEDIAVNSKYQGQGLGKLLIPRT

SEQ ID NO: 2312 - protein, 14 aa, Unknown
  Description of Unknown: Anti-microbial peptide
KLYRKFKNKLLKLK

SEQ ID NO: 2313 - protein, 18 aa, Unknown
  Description of Unknown: Anti-microbial peptide
RRWCFRVCYRGFCRYFCR

SEQ ID NO: 2314 - protein, 4 aa, Unknown
  Description of Unknown: Anti-microbial peptide
HIFR

SEQ ID NO: 2315 - protein, 16 aa, Unknown
  Description of Unknown: Anti-microbial peptide
KPFIRKSYKCLHKRCR

SEQ ID NO: 2316 - protein, 27 aa, Unknown
  Description of Unknown: Anti-microbial peptide
KWKKFIKSLTKSAAKTVVKTAKKPLIV

SEQ ID NO: 2317 - protein, 5 aa, Unknown
  Description of Unknown: Anti-microbial peptide
AGDES

SEQ ID NO: 2318 - protein, 37 aa, Unknown
  Description of Unknown: Anti-microbial peptide
KWKLFKKIEKVGQNIRDGIIKAGPAVAVVGQATQIAK

SEQ ID NO: 2319 - protein, 18 aa, Unknown
  Description of Unknown: Anti-microbial peptide
KVAKQEKKKKKTGRAKRR

SEQ ID NO: 2320 - protein, 24 aa, Unknown
  Description of Unknown: Anti-microbial peptide
RRVVRRVRRVVRRVVRVVRRVVRR

SEQ ID NO: 2321 - protein, 26 aa, Unknown
  Description of Unknown: Anti-microbial peptide
KWKSFIKNLEKVLKPGGLLSNIVTSL

SEQ ID NO: 2322 - protein, 40 aa, Unknown
  Description of Unknown: Anti-microbial peptide
  MOD_RES (2)..(2): Any amino acid
  MOD_RES (4)..(4): Any amino acid
  MOD_RES (9)..(9): Any amino acid
  MOD_RES (11)..(11): Any amino acid
  MOD_RES (18)..(18): Any amino acid
  MOD_RES (21)..(21): Any amino acid
  MOD_RES (23)..(23): Any amino acid
  MOD_RES (26)..(26): Any amino acid
  MOD_RES (29)..(29): Any amino acid
  MOD_RES (32)..(32): Any amino acid
  MOD_RES (34)..(34): Any amino acid
  MOD_RES (36)..(36): Any amino acid
HXHXCTSYXCXKFCGTAXCTXYXCRXLHXGKXCXCXHCSR

SEQ ID NO: 2323 - protein, 18 aa, Unknown
  Description of Unknown: Anti-microbial peptide
RGLRRLGRKIAHGVKKYG

SEQ ID NO: 2324 - protein, 16 aa, Unknown
  Description of Unknown: Anti-microbial peptide
GSSKSPSKKKKKKPGD

SEQ ID NO: 2325 - protein, 32 aa, Unknown
  Description of Unknown: Anti-microbial peptide
KFAKKFAKKFAKKFAKKFAKKFAKKFAKKFAK

SEQ ID NO: 2326 - protein, 4 aa, Unknown
  Description of Unknown: Anti-microbial peptide
CKPV

SEQ ID NO: 2327 - protein, 18 aa, Unknown
  Description of Unknown: Anti-microbial peptide
GYCRCICGRGICRCICGR

SEQ ID NO: 2328 - protein, 21 aa, Unknown
  Description of Unknown: Anti-microbial peptide
RIRRPIHRIARCAGQVVRIVR

SEQ ID NO: 2329 - protein, 7 aa, Unknown
  Description of Unknown: Anti-microbial peptide
HPQYNPR

SEQ ID NO: 2330 - protein, 15 aa, Unknown
  Description of Unknown: Anti-microbial peptide
NNNACKNQCIRLEKA

SEQ ID NO: 2331 - protein, 20 aa, Unknown
  Description of Unknown: Anti-microbial peptide
RHFSGGALIHARYVMTAASC

SEQ ID NO: 2332 - protein, 13 aa, Unknown
  Description of Unknown: Anti-microbial peptide
WRIWKPKWRLPKW

SEQ ID NO: 2333 - protein, 98 aa, Unknown
  Description of Unknown: Anti-microbial peptide
  MOD_RES (64)..(64): Any amino acid
MSKPSRCRAVQTQVALLLLLLVAASLLQAGDAASGFCAGKCAVRCGRSRAKRGACMKYCGLCCXECACVPTGRSGSRDECPCYRDMLTAGPRKRPKCP

SEQ ID NO: 2334 - protein, 46 aa, Unknown
  Description of Unknown: Anti-microbial peptide
LRLLTPAQFKRLGLTVAKRYVKRANQRNRIKRVIRDIDIVVLNKLI

SEQ ID NO: 2335 - protein, 48 aa, Unknown
  Description of Unknown: Anti-microbial peptide
LKLKLKLKLKLKLKLKLKLKLKLKLKLKLKLKLKLKLKLKLKLKLKLK

SEQ ID NO: 2336 - protein, 98 aa, Unknown; identical to SEQ ID NO: 2333
  Description of Unknown: Anti-microbial peptide
  MOD_RES (64)..(64): Any amino acid

SEQ ID NO: 2337 - protein, 21 aa, Unknown
  Description of Unknown: Anti-microbial peptide
RIRRPIHRIARCAGRVVEIVR

SEQ ID NO: 2338 - protein, 7 aa, Unknown
  Description of Unknown: Anti-microbial peptide
YPCYDPA

SEQ ID NO: 2339 - protein, 20 aa, Unknown
  Description of Unknown: Anti-microbial peptide
RHFCAGALIHARFVMTAASS

SEQ ID NO: 2340 - protein, 12 aa, Unknown
  Description of Unknown: Anti-microbial peptide
CLRWPWWPWRRK

SEQ ID NO: 2341 - protein, 114 aa, Unknown
  Description of Unknown: Anti-microbial peptide
MVTKVICFLVLASVLLAVAFPVSALRQQVKKGGGGEGGGGGSVSGSGGGNLNPWECSPKCGSRCSKTQYRKACLTLCNKCCAKCLCVPPGFYGNKGACPCYNNWKTREGGPKCP

SEQ ID NO: 2342 - protein, 46 aa, Unknown
  Description of Unknown: Anti-microbial peptide
WRIRTTAEFRRLGVVASKRNVRKAVWRNRVRRVVKELDIVVLYECI

SEQ ID NO: 2343 - protein, 14 aa, Unknown
  Description of Unknown: Anti-microbial peptide
LRLRLRLRLRLRLR

SEQ ID NO: 2344 - protein, 114 aa, Unknown; identical to SEQ ID NO: 2341
  Description of Unknown: Anti-microbial peptide

SEQ ID NO: 2345 - protein, 9 aa, Unknown
  Description of Unknown: Anti-microbial peptide
RCLCVRGVC

SEQ ID NO: 2346 - protein, 21 aa, Unknown
  Description of Unknown: Anti-microbial peptide
RIRRPIHRIARCIGQVVEIVR

SEQ ID NO: 2347 - protein, 7 aa, Unknown
  Description of Unknown: Anti-microbial peptide
HPAYNAK

SEQ ID NO: 2348 - protein, 20 aa, Unknown
  Description of Unknown: Anti-microbial peptide
RHFCGAALIHARFVMTAASS

SEQ ID NO: 2349 - protein, 103 aa, Unknown
  Description of Unknown: Anti-microbial peptide
MLLLALAAHHQAASDPPATHGGMRASGTRSLLQQQPPPPRLDCPKVCAGRCANNWRKEMCNDKCNVCCQRCNCVPPGTGQDTRHICPCYATMTNPHNGKLKCP

SEQ ID NO: 2350 - protein, 46 aa, Unknown
  Description of Unknown: Anti-microbial peptide
TSLKNQKEFELGIKVSRKLNKKAVVRNKIKRRIRHSNAIIILQYEL

SEQ ID NO: 2351 - protein, 18 aa, Unknown
  Description of Unknown: Anti-microbial peptide
LRLRLRLRLRLRLRLRLR

SEQ ID NO: 2352 - protein, 9 aa, Unknown
  Description of Unknown: Anti-microbial peptide
RCICGRGIC

SEQ ID NO: 2353 - protein, 21 aa, Unknown
  Description of Unknown: Anti-microbial peptide
RIRRPIRRIARCAGQVVEIVR

SEQ ID NO: 2354 - protein, 7 aa, Unknown
  Description of Unknown: Anti-microbial peptide
HPDYNQR

SEQ ID NO: 2355 - protein, 20 aa, Unknown
  Description of Unknown: Anti-microbial peptide
RHFCAAALIHARFVMTAASS

SEQ ID NO: 2356 - protein, 62 aa, Unknown
  Description of Unknown: Anti-microbial peptide
KDCVGACDARCSEHSHKKRCSRSCLTCCSACRCVPAGTAGNRETCGRCYTDWVSHNNMTKCP

SEQ ID NO: 2357 - protein, 51 aa, Unknown
  Description of Unknown: Anti-microbial peptide
ERLRKRPDFLRVGFTATKKIGGAVERNRAKRRLREPLHDYVFLLDDVKTAL

SEQ ID NO: 2358 - protein, 22 aa, Unknown
  Description of Unknown: Anti-microbial peptide
LRLRLRLRLRLRLRLRLRLRLR

SEQ ID NO: 2359 - protein, 105 aa, Unknown
  Description of Unknown: Anti-microbial peptide
MAPGKLAVFALLASLLLLNTIKAADYPPAPPLGPPPHKIVDPGKDCVGACDARCSEHSHKKRCSRSCLTCCSACRCVPAGTAGNRETCGRCYTDWVSHNNMTKCP

SEQ ID NO: 2360 - protein, 103 aa, Unknown; identical to SEQ ID NO: 2349
  Description of Unknown: Anti-microbial peptide

SEQ ID NO: 2361 - protein, 9 aa, Unknown
  Description of Unknown: Anti-microbial peptide
RCICRLGVC

SEQ ID NO: 2362 - protein, 21 aa, Unknown
  Description of Unknown: Anti-microbial peptide
RIRRPIHRIIRCIGQVVRIVR

SEQ ID NO: 2363 - protein, 7 aa, Unknown
  Description of Unknown: Anti-microbial peptide
YPCYDEY

SEQ ID NO: 2364 - protein, 20 aa, Unknown
  Description of Unknown: Anti-microbial peptide
RHFCGGALIHARFLMTAASS

SEQ ID NO: 2365 - protein, 13 aa, Unknown
  Description of Unknown: Anti-microbial peptide
ILKKWPWWPWRRK

SEQ ID NO: 2366 - protein, 64 aa, Unknown
  Description of Unknown: Anti-microbial peptide
LRPWECSPKCAGRCSNTQYKKACLTFCNKCCAKCLCVPPGTYGNKGACPCYNNWKTKEGGPKCP

SEQ ID NO: 2367 - protein, 50 aa, Unknown
  Description of Unknown: Anti-microbial peptide
DSLKNKSEFDKLGLSVSKKVGNAVKRNLIKRRLRSCQALVFLEKHFLEML

SEQ ID NO: 2368 - protein, 33 aa, Unknown
  Description of Unknown: Anti-microbial peptide
KGKKGKKGKKGKKGKKGKKGKKGKKGKKGKKGK

SEQ ID NO: 2369 - protein, 9 aa, Unknown
  Description of Unknown: Anti-microbial peptide
RCICRLGFC

SEQ ID NO: 2370 - protein, 21 aa, Unknown
  Description of Unknown: Anti-microbial peptide
RIRRPIRRIIRCIGQVVEIVR

SEQ ID NO: 2371 - protein, 7 aa, Unknown
  Description of Unknown: Anti-microbial peptide
HPDYNPK

SEQ ID NO: 2372 - protein, 15 aa, Unknown
  Description of Unknown: Anti-microbial peptide
NYVFPAHKCICYFPC

SEQ ID NO: 2373 - protein, 20 aa, Unknown
  Description of Unknown: Anti-microbial peptide
RHFCGGALIHARFIMTAASS

SEQ ID NO: 2374 - protein, 13 aa, Unknown
  Description of Unknown: Anti-microbial peptide
ILKKWVWWVWRRK

SEQ ID NO: 2375 - protein, 88 aa, Unknown
  Description of Unknown: Anti-microbial peptide
MKVAFVAVLLICLVLSSSLFEVSMAGSAFCSSKCAKRCSRAGMKDRCTRFCGICCSKCRCVPSGTYGNKHECPCYRDMKNSKGKPKCP

SEQ ID NO: 2376 - protein, 45 aa, Unknown
  Description of Unknown: Anti-microbial peptide
KGKKGKKGKKGKKGKKGKKGKKGKKGKKGKKGKKGKKGKKGKKGK

SEQ ID NO: 2377 - protein, 9 aa, Unknown
  Description of Unknown: Anti-microbial peptide
RCICTLGVC

SEQ ID NO: 2378 - protein, 24 aa, Unknown
  Description of Unknown: Anti-microbial peptide
LIRELGQRIRRPIHRIARCAGQVV

SEQ ID NO: 2379 - protein, 7 aa, Unknown
  Description of Unknown: Anti-microbial peptide
HPDYNPD

SEQ ID NO: 2380 - protein, 54 aa, Unknown; identical to SEQ ID NO: 132
  Description of Unknown: Anti-microbial peptide

SEQ ID NO: 2381 - protein, 20 aa, Unknown
  Description of Unknown: Anti-microbial peptide
RHFCGGALIHARFAMTAASS

SEQ ID NO: 2382 - protein, 13 aa, Unknown
  Description of Unknown: Anti-microbial peptide
ILKKWPWWVWRRK

SEQ ID NO: 2383 - protein, 88 aa, Unknown
  Description of Unknown: Anti-microbial peptide
MKVAFAAVLLICLVLSSSLFEVSMAGSAFCSSKCSKRCSRAGMKDRCMKFCGICCSKCNCVPSGTYGNKHECPCYRDMKNSKGKAKCP

SEQ ID NO: 2384 - protein, 50 aa, Unknown
  Description of Unknown: Anti-microbial peptide
DKFSTNEEFSKIAVVASKKVGKAVVRNRSKRILRALQKYIFLEKNLKWGL

SEQ ID NO: 2385 - protein, 109 aa, Unknown
  Description of Unknown: Anti-microbial peptide
QPHRLLKKNHFDFVFQSAKKIPTDDFIFLFRENKLGYARLGLALSKKMIAKAHDRNRIKRLLRESFRHTNLPAVDIIILARPGLAKKTNLGINTKLNKTWEKLASCYGK

SEQ ID NO: 2386 - protein, 21 aa, Unknown
  Description of Unknown: Anti-microbial peptide
KTKKTKKTKKTKKTKKTKKTK

SEQ ID NO: 2387 - protein, 9 aa, Unknown
  Description of Unknown: Anti-microbial peptide
RCICTLGFC

SEQ ID NO: 2388 - protein, 24 aa, Unknown
  Description of Unknown: Anti-microbial peptide
LIRELRQRIRRPIHRIARCARQVV

SEQ ID NO: 2389 - protein, 7 aa, Unknown
  Description of Unknown: Anti-microbial peptide
HPDYNAT

SEQ ID NO: 2390 - protein, 50 aa, Unknown; identical to SEQ ID NO: 133
  Description of Unknown: Anti-microbial peptide

SEQ ID NO: 2391 - protein, 20 aa, Unknown
  Description of Unknown: Anti-microbial peptide
RHYCGGALIHARFVMTAASS

SEQ ID NO: 2392 - protein, 13 aa, Unknown
  Description of Unknown: Anti-microbial peptide
ILKKWVWWPWRRK

SEQ ID NO: 2393 - protein, 51 aa, Unknown
  Description of Unknown: Anti-microbial peptide
QKLCERPSRTWSGVCGNNNACKNQCINLEKARHGSCNYVFPAHKCICYFPC

SEQ ID NO: 2394 - protein, 88 aa, Unknown
  Description of Unknown: Anti-microbial peptide
MKLEFANVLLLCLVLSSSFLEISMAGSPFCDSKCAQRCAKAGVQDRCLRFCGICCEKCNCVPSGTYGNKDECPCYRDMKNSKGKDKCP

SEQ ID NO: 2395 - protein, 46 aa, Unknown
  Description of Unknown: Anti-microbial peptide
YRLLKTDDFSRIGLVVGKKTAKRANERNYMKRVIRDLDFVVARAEL

SEQ ID NO: 2396 - protein, 4 aa, Unknown
  Description of Unknown: Anti-microbial peptide
KFAK

SEQ ID NO: 2397 - protein, 88 aa, Unknown; identical to SEQ ID NO: 2394
  Description of Unknown: Anti-microbial peptide

SEQ ID NO: 2398 - protein, 9 aa, Unknown
  Description of Unknown: Anti-microbial peptide
RCICVLGVC

SEQ ID NO: 2399 - protein, 24 aa, Unknown
  Description of Unknown: Anti-microbial peptide
LIRELGQRIRRPIHRIARCAGRVV

SEQ ID NO: 2400 - protein, 7 aa, Unknown
  Description of Unknown: Anti-microbial peptide
HPAYDDK

SEQ ID NO: 2401 - protein, 50 aa, Unknown; identical to SEQ ID NO: 174
  Description of Unknown: Anti-microbial peptide

SEQ ID NO: 2402 - protein, 20 aa, Unknown
  Description of Unknown: Anti-microbial peptide
RHFCGGALIHARYVMTAASS

SEQ ID NO: 2403 - protein, 12 aa, Unknown
  Description of Unknown: Anti-microbial peptide
ILRWVWWVWRRK

SEQ ID NO: 2404 - protein, 51 aa, Unknown
  Description of Unknown: Anti-microbial peptide
QKLCERPSGTWSGVCGNNNACKNQCINLEKARHGSCNYRFPAHKCICYFPC

SEQ ID NO: 2405 - protein, 90 aa, Unknown
  Description of Unknown: Anti-microbial peptide
MKLVFATLLLCSLLLSSSFLEPVIAYEDSSYCSNKCSDRCSSAGVKDRCLRYCGICCAECKCVPSGTYGNKHQCPCYRDKLNKKGKPKCP

SEQ ID NO: 2406 - protein, 8 aa, Unknown
  Description of Unknown: Anti-microbial peptide
KFAKKFAK

SEQ ID NO: 2407 - protein, 90 aa, Unknown; identical to SEQ ID NO: 2405
  Description of Unknown: Anti-microbial peptide

SEQ ID NO: 2408 - protein, 9 aa, Unknown
  Description of Unknown: Anti-microbial peptide
RCICVLGFC

SEQ ID NO: 2409 - protein, 24 aa, Unknown
  Description of Unknown: Anti-microbial peptide
LIRELGQRIRRPIHRIARCIGQVV

SEQ ID NO: 2410 - protein, 7 aa, Unknown
  Description of Unknown: Anti-microbial peptide
HPAFDRK

SEQ ID NO: 2411 - protein, 13 aa, Unknown
  Description of Unknown: Anti-microbial peptide
IRLEKARHGSCNY

SEQ ID NO: 2412 - protein, 20 aa, Unknown
  Description of Unknown: Anti-microbial peptide
  MOD_RES (3)..(3): Any amino acid
  MOD_RES (5)..(9): Any amino acid
  MOD_RES (11)..(11): Any amino acid
  MOD_RES (13)..(14): Any amino acid
  MOD_RES (16)..(20): Any amino acid
RHXCXXXXXHXRXXMXXXXX

SEQ ID NO: 2413 - protein, 12 aa, Unknown
  Description of Unknown: Anti-microbial peptide
KRRWVWWVWRLI

SEQ ID NO: 2414 - protein, 51 aa, Unknown
  Description of Unknown: Anti-microbial peptide
QKLCERPSRTWSGVCGNNNACKNQCINLEKARHGSCNYRFPAHKCICYFPC

SEQ ID NO: 2415 - protein, 90 aa, Unknown
  Description of Unknown: Anti-microbial peptide
MKLVFGTLLLCSLLLSFSFLEPVIAYEDSSYCSNKCADRCSSAGVKDRCVKYCGICCAECKCVPSGTYGNKHECPCYRDKLNKKGKPKCP

SEQ ID NO: 2416 - protein, 50 aa, Unknown
  Description of Unknown: Anti-microbial peptide
ARLHRPSEFARLGLVIAKRFAARAVTRNTLKRVIRELDYVVLKRSARAEV

SEQ ID NO: 2417 - protein, 12 aa, Unknown
  Description of Unknown: Anti-microbial peptide
KFAKKFAKKFAK

SEQ ID NO: 2418 - protein, 9 aa, Unknown
  Description of Unknown: Anti-microbial peptide
RCLCGLGVC

SEQ ID NO: 2419 - protein, 43 aa, Unknown
  Description of Unknown: Anti-microbial peptide
IRALQRAVRHPRAIRRIYRGWKKAIRAGPGVTIGIAHAKSQLW

SEQ ID NO: 2420 - protein, 29 aa, Unknown
  Description of Unknown: Anti-microbial peptide
RIAGYGLRGLAVIIRICIRGLNLIFEIIR

SEQ ID NO: 2421 - protein, 7 aa, Unknown
  Description of Unknown: Anti-microbial peptide
HPAYNPR

SEQ ID NO: 2422 - protein, 19 aa, Unknown
  Description of Unknown: Anti-microbial peptide
MVSRAAGLAARLARLALRA

SEQ ID NO: 2423 - protein, 15 aa, Unknown
  Description of Unknown: Anti-microbial peptide
ILPWKWPWWPWRKWR

SEQ ID NO: 2424 - protein, 42 aa, Unknown; identical to SEQ ID NO: 30
  Description of Unknown: Anti-microbial peptide

SEQ ID NO: 2425 - protein, 9 aa, Unknown
  Description of Unknown: Anti-microbial peptide
ALYLAIRKR

SEQ ID NO: 2426 - protein, 18 aa, Unknown
  Description of Unknown: Anti-microbial peptide
KNLRREIRKIIHIIKKYG

SEQ ID NO: 2427 - protein, 6 aa, Unknown
  Description of Unknown: Anti-microbial peptide
FPAHKC

SEQ ID NO: 2428 - protein, 18 aa, Unknown
  Description of Unknown: Anti-microbial peptide
GKLKKKWKAAKKFLKKCS

SEQ ID NO: 2429 - protein, 14 aa, Unknown
  Description of Unknown: Anti-microbial peptide
  MOD_RES (1)..(2): Any amino acid
  MOD_RES (5)..(5): Any amino acid
  MOD_RES (9)..(9): Any amino acid
  MOD_RES (12)..(13): Any amino acid
XXLFXELLXSLXXY

SEQ ID NO: 2430 - protein, 13 aa, Unknown
  Description of Unknown: Anti-microbial peptide
YKIIQQWFHWRRV

SEQ ID NO: 2431 - protein, 20 aa, Unknown
  Description of Unknown: Anti-microbial peptide
RHFCGGALIHARFVMTAASS

SEQ ID NO: 2432 - protein, 10 aa, Unknown
  Description of Unknown: Anti-microbial peptide
NVKFYEKCGF

SEQ ID NO: 2433 - protein, 13 aa, Unknown
  Description of Unknown: Anti-microbial peptide
ARYRKFKNKILKS

SEQ ID NO: 2434 - protein, 18 aa, Unknown
  Description of Unknown: Anti-microbial peptide
RRWCFIVCRRGACYRRCR

SEQ ID NO: 2435 - protein, 12 aa, Unknown
  Description of Unknown: Anti-microbial peptide
RKSYKCLHKRCR

SEQ ID NO: 2436 - protein, 32 aa, Unknown
  Description of Unknown: Anti-microbial peptide
KWKLFKKIGIGAVLKVLKVLTTGLPALKLTLK

SEQ ID NO: 2437 - protein, 83 aa, Unknown
  Description of Unknown: Anti-microbial peptide
NLAKGKEESLDSDLYAELRCMCIKTTSGIHPKNIQSLEVIGKGTHCNQVEVIATLKDGRKICLDPDAPRIKKIVQKKLAGDES

SEQ ID NO: 2438 - protein, 36 aa, Unknown
  Description of Unknown: Anti-microbial peptide
KWKVFKKIEKMGRNIRNGIVKAGPAIAVLGEAKALG

SEQ ID NO: 2439 - protein, 20 aa, Unknown
  Description of Unknown: Anti-microbial peptide
AKVAKQEKKKKKTGRAKRRA

SEQ ID NO: 2440 - protein, 36 aa, Unknown
  Description of Unknown: Anti-microbial peptide
VRRVVRRVVRVVRRVVRRVRRVVRRVVRVVRRVVRR

SEQ ID NO: 2441 - protein, 26 aa, Unknown
  Description of Unknown: Anti-microbial peptide
KWKSFIKNLEKVLKKGPILANLVSIV

SEQ ID NO: 2442 - protein, 40 aa, Unknown
  Description of Unknown: Anti-microbial peptide
HSHACTSYWCGKFCGTASCTHYLCRVLHPGKMCACVHCSR

SEQ ID NO: 2443 - protein, 20 aa, Unknown
  Description of Unknown: Anti-microbial peptide
SPSNETPKKKKKRFSFKKSG

SEQ ID NO: 2444 - protein, 48 aa, Unknown
  Description of Unknown: Anti-microbial peptide
KFAKKFAKKFAKKFAKKFAKKFAKKFAKKFAKKFAKKFAKKFAKKFAK

SEQ ID NO: 2445 - protein, 8 aa, Unknown
  Description of Unknown: Anti-microbial peptide
  MOD_RES (4)..(4): Any amino acid
VPKXCKPV

SEQ ID NO: 2446 - protein, 18 aa, Unknown
  Description of Unknown: Anti-microbial peptide
GICRCICGRGYCRCICGR

SEQ ID NO: 2447 - protein, 24 aa, Unknown
  Description of Unknown: Anti-microbial peptide
LIRELGQRIRRPIRRIARCAGQVV

SEQ ID NO: 2448 - protein, 13 aa, Unknown
  Description of Unknown: Anti-microbial peptide
RLEKARHGSCNYV

SEQ ID NO: 2449 - protein, 20 aa, Unknown
  Description of Unknown: Anti-microbial peptide
  MOD_RES (3)..(9): Any amino acid
  MOD_RES (11)..(11): Any amino acid
  MOD_RES (13)..(14): Any amino acid
  MOD_RES (16)..(19): Any amino acid
RHXXXXXXXHXRXXMXXXXC

SEQ ID NO: 2450 - protein, 13 aa, Unknown
  Description of Unknown: Anti-microbial peptide
ILRRWVWWVWRRK

SEQ ID NO: 2451 - protein, 51 aa, Unknown
  Description of Unknown: Anti-microbial peptide
QKLCMRPSGTWSGVCGNNNACKNQCINLEKARHGSCNYVFPAHKCICYFPC

SEQ ID NO: 2452 - protein, 96 aa, Unknown
  Description of Unknown: Anti-microbial peptide
MAISKSTVVVVILCFILIQELGIYGEDPHMDAAKKIDCGGKCNSRCSKARRQKMCIRACNSCCKKCRCVPPGTSGNRDLCPCYARLTTHGGKLKCP

SEQ ID NO: 2453 - protein, 45 aa, Unknown
  Description of Unknown: Anti-microbial peptide
DRLRQKVAIQRLGLAVSRKVGNAVVRNRIKRRLRETDVLVMGAYL

SEQ ID NO: 2454 - protein, 113 aa, Unknown
  Description of Unknown: Anti-microbial peptide
MANFISLKKNEDILDTIKKQQKIHSNQIVVYFRKTNLKNVRLAISISKKKFKLATQRNRIRRLIKAWFIAADIPIKSYDIVVLVKPSFIDGSFVLNCNNLKIILQRIINKEKR

SEQ ID NO: 2455 - protein, 14 aa, Unknown
  Description of Unknown: Anti-microbial peptide
LKLKLKLKLKLKLK

SEQ ID NO: 2456 - protein, 9 aa, Unknown
  Description of Unknown: Anti-microbial peptide
RCLCGLGIC

SEQ ID NO: 2457 - protein, 24 aa, Unknown
  Description of Unknown: Anti-microbial peptide
LIRELGIRIRRPIHRIARCAGQVV

SEQ ID NO: 2458 - protein, 13 aa, Unknown
  Description of Unknown: Anti-microbial peptide
LEKARHGSCNYVF

SEQ ID NO: 2459 - protein, 14 aa, Unknown
  Description of Unknown: Anti-microbial peptide
ILRWWVWWVWWRRK

SEQ ID NO: 2460 - protein, 51 aa, Unknown
  Description of Unknown: Anti-microbial peptide
QKLCERPSGTWSGVCMNNNACKNQCINLEKARHGSCNYVFPAHKCICYFPC

SEQ ID NO: 2461 - protein, 108 aa, Unknown
  Description of Unknown: Anti-microbial peptide
MMGILLLVCLAKVSSDVNMQKEEDEELRFPNHPLIVRDGNRRLMQDIDCGGLCKTRCSAHSRPNVCNRACGTCCVRCKCVPPGTSGNRELCGTCYTDMITHGNKTKCP

SEQ ID NO: 2462 - protein, 46 aa, Unknown
  Description of Unknown: Anti-microbial peptide
NRLRRREDFARAGFVVSKAVGGAVVRNQVKRRLRHLPLVVVLARDL

SEQ ID NO: 2463 - protein, 71 aa, Unknown
  Description of Unknown: Anti-microbial peptide
LRLLTPSQFTFVFRIGLTVAKKNVRRAHERNRIKRLTRESFRLRQHELDFVVVAKKGVADLDNRALSEALE

SEQ ID NO: 2464 - protein, 80 aa, Unknown
  Description of Unknown: Anti-microbial peptide
KFAKKFAKKFAKKFAKKFAKKFAKKFAKKFAKKFAKKFAKKFAKKFAKKFAKKFAKKFAKKFAKKFAKKFAKKFAKKFAK

SEQ ID NO: 2465 - protein, 108 aa, Unknown; identical to SEQ ID NO: 2461
  Description of Unknown: Anti-microbial peptide

SEQ ID NO: 2466 - protein, 9 aa, Unknown
  Description of Unknown: Anti-microbial peptide
RCLCTLGVC

SEQ ID NO: 2467 - protein, 24 aa, Unknown
  Description of Unknown: Anti-microbial peptide
LIRRLGQRIRRPIHRIARCAGQVV

SEQ ID NO: 2468 - protein, 13 aa, Unknown
  Description of Unknown: Anti-microbial peptide
EKARHGSCNYVFP

SEQ ID NO: 2469 - protein, 11 aa, Unknown
  Description of Unknown: Anti-microbial peptide
RLWVWWVWRRK

SEQ ID NO: 2470 - protein, 117 aa, Unknown
  Description of Unknown: Anti-microbial peptide
MAPRVFLVLGMLLMVCLVKVSSDPKREEEILEEELHFPDNEPLIVRDGNRRLMQDIDCGGLCKTRCSAHSRPNLCTRACGTCCVRCKCVPPGTSGNRELCGTCYTDMTTHGNKTKCP

SEQ ID NO: 2471 - protein, 46 aa, Unknown
  Description of Unknown: Anti-microbial peptide
NRLRRREDFARAGFVVSKAVGVAVVRNKVKRRLRHLPLVVVLARDL

SEQ ID NO: 2472 - protein, 71 aa, Unknown
  Description of Unknown: Anti-microbial peptide
LRLLTPKHFNFVFRIGLTIAKKNVKRAHERNRIKRLAREYFRLHQHQLDFVVLVRKGVAELDNHQLTEVLG

SEQ ID NO: 2473 - protein, 9 aa, Unknown
  Description of Unknown: Anti-microbial peptide
KFKKFKKFK

SEQ ID NO: 2474 - protein, 117 aa, Unknown; identical to SEQ ID NO: 2470
  Description of Unknown: Anti-microbial peptide

SEQ ID NO: 2475 - protein, 9 aa, Unknown
  Description of Unknown: Anti-microbial peptide
RCLCTLGIC

SEQ ID NO: 2476 - protein, 21 aa, Unknown
  Description of Unknown: Anti-microbial peptide
LIRELGQRIRRPIHRIARCAG

SEQ ID NO: 2477 - protein, 13 aa, Unknown
  Description of Unknown: Anti-microbial peptide
KARHGSCNYVFPA

SEQ ID NO: 2478 - protein, 119 aa, Unknown
  Description of Unknown: Anti-microbial peptide
MALRVLLVLGMLLMLCLVKVSSDPKIEEEILEAEEELQFPDNEPLIVRDANRRLMQDMDCGGLCKTRCSAHSRPNLCTRACGTCCVRCKCVPPGTSGNRELCGTCYTDMTTHGNKTKCP

SEQ ID NO: 2479 - protein, 51 aa, Unknown
  Description of Unknown: Anti-microbial peptide
RRVRTPAEFRRAGFVVSKAVGNAVTRNRVKRRLRALPVLVQVLRRETVGAL

SEQ ID NO: 2480 - protein, 71 aa, Unknown
  Description of Unknown: Anti-microbial peptide
LRLLTPIQFKNVFRLGLTVAKKHLKRAHERNRIKRLVRESFRLSQHRLDFVFVAKNGIGKLDNNTFAQILE

SEQ ID NO: 2481 - protein, 12 aa, Unknown
  Description of Unknown: Anti-microbial peptide
KFKKFKKFKKFK

SEQ ID NO: 2482 - protein, 119 aa, Unknown; identical to SEQ ID NO: 2478
  Description of Unknown: Anti-microbial peptide

SEQ ID NO: 2483 - protein, 9 aa, Unknown
  Description of Unknown: Anti-microbial peptide
RCLCVLGVC

SEQ ID NO: 2484 - protein, 21 aa, Unknown
  Description of Unknown: Anti-microbial peptide
LIRELGQRIRRPIHRIARCAR

SEQ ID NO: 2485 - protein, 13 aa, Unknown
  Description of Unknown: Anti-microbial peptide
ARHGSCNYVFPAH

SEQ ID NO: 2486 - protein, 13 aa, Unknown
  Description of Unknown: Anti-microbial peptide
RLGGGWVWWVWRR

SEQ ID NO: 2487 - protein, 99 aa, Unknown
  Description of Unknown: Anti-microbial peptide
MALSKLIIASLLASLLLLHFVDADQSAHAQTQGSLLQQIDCNGACAARCRLSSRPRLCQRACGTCCRRCNCVPPGTAGNQEVCPCYASLTTHGGKRKCP

SEQ ID NO: 2488 - protein, 47 aa, Unknown
  Description of Unknown: Anti-microbial peptide
NRMRRSADFERVGLIIAKSVGSAVERHRVARRLRHLHDHVVILEQQL

SEQ ID NO: 2489 - protein, 71 aa, Unknown
  Description of Unknown: Anti-microbial peptide
KNLLTPRHFKAVFRLGLVIGKKSVKLAVQRNRLKRLMRDSFRLNQQLLDIVIVARKGLGEIENPELHQHFG

SEQ ID NO: 2490 - protein, 21 aa, Unknown
  Description of Unknown: Anti-microbial peptide
KGKKGKKGKKGKKGKKGKKGK

SEQ ID NO: 2491 - protein, 99 aa, Unknown; identical to SEQ ID NO: 2487
  Description of Unknown: Anti-microbial peptide

SEQ ID NO: 2492 - protein, 9 aa, Unknown
  Description of Unknown: Anti-microbial peptide
RCLCVLGIC

SEQ ID NO: 2493 - protein, 21 aa, Unknown
  Description of Unknown: Anti-microbial peptide
LIRELGQRIRRPIHRIARCAI

SEQ ID NO: 2494 - protein, 13 aa, Unknown
  Description of Unknown: Anti-microbial peptide
RHGSCNYVFPAHK

SEQ ID NO: 2495 - protein, 10 aa, Unknown
  Description of Unknown: Anti-microbial peptide
RLWWVVWWRR

SEQ ID NO: 2496 - protein, 115 aa, Unknown
  Description of Unknown: Anti-microbial peptide
MEKKRKTLLLLLLMAATLFCMPIVSYAVSSVNIQGHLTHSELVKGPNRRLLPFVDCGARCRVRCSLHSRPKICSRACGTCCFRCRCVPPGTYGNREMCGKCYTDMITHGNKPKCP

SEQ ID NO: 2497 - protein, 47 aa, Unknown
  Description of Unknown: Anti-microbial peptide
NRMRRSSEFDHVGLIIAKTVGSAVERHRVARRLRHLGDQVVILAQQL

SEQ ID NO: 2498 - protein, 71 aa, Unknown
  Description of Unknown: Anti-microbial peptide
SKLLKSTNFQYVFRLGLSISRKNIKHAYRRNKIKRLIRETFRLLQHRLDFVVIAKKNIVYLNNKKIVNILE

SEQ ID NO: 2499 - protein, 23 aa, Unknown
  Description of Unknown: Anti-microbial peptide
FAKKFAKKFKKFAKKFAKFAFAF

SEQ ID NO: 2500 - protein, 115 aa, Unknown; identical to SEQ ID NO: 2496
  Description of Unknown: Anti-microbial peptide

SEQ ID NO: 2501 - protein, 140 aa, Unknown
  Description of Unknown: Anti-microbial peptide
VTPAMRTFALLTAMLLLVALAQAEPLQARADEAAAQEQPGADDQEMAHAFTWHESAALPLSDSARGLRCICGRGICRLLRRFGSCAFRGTLHRICCRACRIKKHKLRIYFESKKFLLLLYLVLHFLFSSKINTLLQDFSL

SEQ ID NO: 2502 - protein, 21 aa, Unknown
  Description of Unknown: Anti-microbial peptide
LIRELGQRIRRPIHRIARCIG

SEQ ID NO: 2503 - protein, 13 aa, Unknown
  Description of Unknown: Anti-microbial peptide
HGSCNYVFPAHKC

SEQ ID NO: 2504 - protein, 10 aa, Unknown
  Description of Unknown: Anti-microbial peptide
RLVVWWVVRR

SEQ ID NO: 2505 - protein, 191 aa, Unknown
  Description of Unknown: Anti-microbial peptide
MASNSILLLCIFLVVATKVFSYDEDLKTVVPAPAPPVKAPTLAPPVKSPSYPPGPVTTPTVPTPTVKVPPPPQSPVVKPPTPTVPPPTVKVPPPPQSPVVKPPTPTPTSPVVYPPPVAPSPPAPVVKSNKDCIPLCDYRCSLHSRKKLCMRACITCCDRCKCVPPGTYGNREKCGKCYTDMLTHGNKFKCP

SEQ ID NO: 2506 - protein, 71 aa, Unknown
  Description of Unknown: Anti-microbial peptide
  MOD_RES (31)..(31): Any amino acid
LRLLTPAHFTFVFRIGLTVAKKNVRRAHERXRIKRLTRESFRLRQHELDFVVVAKKGVADLDNRALSEALE

SEQ ID NO: 2507 - protein, 17 aa, Unknown
  Description of Unknown: Anti-microbial peptide
FKLRAKIKVRLRAKIKL

SEQ ID NO: 2508 - protein, 191 aa, Unknown; identical to SEQ ID NO: 2505
  Description of Unknown: Anti-microbial peptide

SEQ ID NO: 2509 - protein, 140 aa, Unknown
  Description of Unknown: Anti-microbial peptide
VTPAMRTFALLAAMLLLVALAEAEPLQARADETAAQEQPGADDQEMAHAFTWDESATLPLSDSARGLRCICRRGVCRFLRHLGSCAFRGTLHRICCRACRIKKNKLRIYFESKKFVFLLYLALHFLFSSKINTLLQDFCL

SEQ ID NO: 2510 - protein, 21 aa, Unknown
  Description of Unknown: Anti-microbial peptide
LIRELGQRIRRPIRRIARCAG

SEQ ID NO: 2511 - protein, 13 aa, Unknown
  Description of Unknown: Anti-microbial peptide
GSCNYVFPAHKCI

SEQ ID NO: 2512 - protein, 10 aa, Unknown
  Description of Unknown: Anti-microbial peptide
RLFVWWVFRR

SEQ ID NO: 2513 - protein, 107 aa, Unknown
  Description of Unknown: Anti-microbial peptide
MAKFFAAMILALFAISILQTVVMAANEQGGHLYDNKSKYGSGSVKSYQCPSQCSRRCSQTQYHKPCMFFCQKCCRTCLCVPPGYYGNKAVCPCYNNWKTKEGGPKCP

SEQ ID NO: 2514 - protein, 47 aa, Unknown
  Description of Unknown: Anti-microbial peptide
NRMTRSTEFDRVGLVVGKAVGTAVQRHRVARRLRHLEDRLVILAQEL

SEQ ID NO: 2515 - protein, 71 aa, Unknown
  Description of Unknown: Anti-microbial peptide
LRLLTPSHFTFVFRIGLTVAKKHVKRAHERNRIKRLTRESFRLHQHALDFVVLVKKGVADLDNRALTEALE

SEQ ID NO: 2516 - protein, 16 aa, Unknown
  Description of Unknown: Anti-microbial peptide
KFAKKFAKKFAKKAAK

SEQ ID NO: 2517 - protein, 107 aa, Unknown; identical to SEQ ID NO: 2513
  Description of Unknown: Anti-microbial peptide

SEQ ID NO: 2518 - protein, 141 aa, Unknown
  Description of Unknown: Anti-microbial peptide
VTPAMRTFTVLAAMLLVVALQAQAEPLRARADETAAQEQPGADDQEMAHAFTWDESAALPLSDSARGLRCICRRGVCRFLRHLGSCAFRGTLHRICCRACRIKKNKLRIYFESKKFVFLLYLALHFLFSSKINTLLQDFCL

SEQ ID NO: 2519 - protein, 21 aa, Unknown
  Description of Unknown: Anti-microbial peptide
LIRELGIRIRRPIHRIARCAG

SEQ ID NO: 2520 - protein, 13 aa, Unknown
  Description of Unknown: Anti-microbial peptide
SCNYVFPAHKCIC

SEQ ID NO: 2521 - protein, 10 aa, Unknown
  Description of Unknown: Anti-microbial peptide
RLVVWVVWRR

SEQ ID NO: 2522 - protein, 107 aa, Unknown
  Description of Unknown: Anti-microbial peptide
MAKFFAAMILALIAISMLQTVVMAANEQGGHLYDNKSKYGSGSVKRYQCPSQCSRRCSQTQYHKPCMFFCQKCCRKCLCVPPGYYGNKAVCPCYNNWKTKEGGPKCP

SEQ ID NO: 2523 - protein, 48 aa, Unknown
  Description of Unknown: Anti-microbial peptide
HKLSNSEQFRRFGLVVSKAVGNAVTRHRVSRQLRHFHVVLRADVQAAL

SEQ ID NO: 2524 - protein, 71 aa, Unknown
  Description of Unknown: Anti-microbial peptide
LRLLTPSHFTFVFRIGLTVAKKNVKRAHERNRIKRLTRESFRLRQHELDFVVVAKRGVADLDNRALSEALE

SEQ ID NO: 2525 - protein, 16 aa, Unknown
  Description of Unknown: Anti-microbial peptide
KFAKKFAKKAAKKAAK

SEQ ID NO: 2526 - protein, 107 aa, Unknown; identical to SEQ ID NO: 2522
  Description of Unknown: Anti-microbial peptide

SEQ ID NO: 2527 - protein, 141 aa, Unknown
  Description of Unknown: Anti-microbial peptide
VTPAMRTFTVLAAMLLVVALQAQAEPLRARADETAAQEQPGADDQEMAHAFTWDESAALPLSDSARGLRCICRRGVCRLLRHFGSCAFRGTLHRICCRACRIKKNKLRIYFESKKFLFLLYLALHFLFSSKINTLLQDFCL

SEQ ID NO: 2528 - protein, 21 aa, Unknown
  Description of Unknown: Anti-microbial peptide
LIRRLGQRIRRPIHRIARCAG

SEQ ID NO: 2529 - protein, 13 aa, Unknown
  Description of Unknown: Anti-microbial peptide
CNYVFPAHKCICY

SEQ ID NO: 2530 - protein, 45 aa, Unknown
  Description of Unknown: Anti-microbial peptide
ERLRLRRDFLRLGIVVKRKFGKATRRNKLKRWVREIDIVVVREKL

SEQ ID NO: 2531 - protein, 66 aa, Unknown
  Description of Unknown: Anti-microbial peptide
IRLPATSTRIGLTVAKKNVRRAHERNRIKRLTRESFRLRQHELDFVVVAKKGVADLDNRALSEALE

SEQ ID NO: 2532 - protein, 16 aa, Unknown
  Description of Unknown: Anti-microbial peptide
KFAKKAAKKFAKKAAK

SEQ ID NO: 2533 - protein, 110 aa, Unknown
  Description of Unknown: Anti-microbial peptide
MAVANKLLSVLIIALIAISMLQTVVMASHGHGGHHYNDKKKYGPGSLKSFQCPSQCSRRCGKTQYHKPCMFFCQKCCRKCLCVPPGYYGNKAVCPCYNNWKTKEGGPKCP

SEQ ID NO: 2534 - protein, 140 aa, Unknown
  Description of Unknown: Anti-microbial peptide
VTPAMRTFALLTAMLLLVDLAQAEPLQARADEAAAQEQPGADDQEMAHAFTWDESAALPLSDSARGLRCICGRGICRLLRRFGSCAFRGTLHRICCRACRIKKNKLRIYFETKKFLLLLYLVLHFLFSSKINTLLQDFCL

SEQ ID NO: 2535 - protein, 38 aa, Unknown
  Description of Unknown: Anti-microbial peptide
KLIRKLIRWLRRKIRALQRAVAGPGVTIGIAHAKSQLW

SEQ ID NO: 2536 - protein, 21 aa, Unknown
  Description of Unknown: Anti-microbial peptide
RVIEVVQGACRAIRHIPRRIR

SEQ ID NO: 2537 - protein, 7 aa, Unknown
  Description of Unknown: Anti-microbial peptide
HPAYNQR

SEQ ID NO: 2538 - protein, 20 aa, Unknown
  Description of Unknown: Anti-microbial peptide
MVSRAAGLAARLARLALRAL

SEQ ID NO: 2539 - protein, 80 aa, Unknown
  Description of Unknown: Anti-microbial peptide
MKTTILILLILGLGINAKSLEERKSEEEKAFKLLGRIIHHVGNFVYGFSHVFGDDQQDNGKFYGHYAEDNGKHWYDTGDQ

SEQ ID NO: 2540 - protein, 15 aa, Unknown
  Description of Unknown: Anti-microbial peptide
ILPWKWPWWPWRRWR

SEQ ID NO: 2541 - protein, 40 aa, Unknown; identical to SEQ ID NO: 32
  Description of Unknown: Anti-microbial peptide

SEQ ID NO: 2542 - protein, 69 aa, Unknown
  Description of Unknown: Anti-microbial peptide
MKTHYFLLVMICFLFSQMEPGVGILTSLGRRTDQYKCLQHGGFCLRSSCPSNTKLQGTCKPDKPNCCKS

SEQ ID NO: 2543 - protein, 9 aa, Unknown
  Description of Unknown: Anti-microbial peptide
ALWLAIRKR

SEQ ID NO: 2544 - protein, 18 aa, Unknown
  Description of Unknown: Anti-microbial peptide
KNLRRDIRKIIHIIKKYG

SEQ ID NO: 2545 - protein, 6 aa, Unknown
  Description of Unknown: Anti-microbial peptide
AHKCIC

SEQ ID NO: 2546 - protein, 18 aa, Unknown
  Description of Unknown: Anti-microbial peptide
GKWKLFKKAAKKFLKKCS

SEQ ID NO: 2547 - protein, 62 aa, Unknown
  Description of Unknown: Anti-microbial peptide
EVYKGGYTRPIPRPPPFVRPLPGGPIGPYNGCPVSCRGISFSQARSCCSRLGRCCHVGKGYS

SEQ ID NO: 2548 - protein, 12 aa, Unknown
  Description of Unknown: Anti-microbial peptide
YQVIQSWEHWRE

SEQ ID NO: 2549 - protein, 25 aa, Unknown
  Description of Unknown: Anti-microbial peptide
NQGRHFSGGALIHARFVMTAASSFQ

SEQ ID NO: 2550 - protein, 20 aa, Unknown
  Description of Unknown: Anti-microbial peptide
VEDVVVSDECRGKQLGKLLL

SEQ ID NO: 2551 - protein, 13 aa, Unknown
  Description of Unknown: Anti-microbial peptide
ARYRKFRNKILRS

SEQ ID NO: 2552 - protein, 19 aa, Unknown
  Description of Unknown: Anti-microbial peptide
RRWCFIVCRRGRCYVACRR

SEQ ID NO: 2553 - protein, 11 aa, Unknown
  Description of Unknown: Anti-microbial peptide
KSYKCLHKRCR

SEQ ID NO: 2554 - protein, 30 aa, Unknown
  Description of Unknown: Anti-microbial peptide
KLFKKIGIGAVLKVLKVLTTGLPALKLTLK

SEQ ID NO: 2555 - protein, 13 aa, Unknown
  Description of Unknown: Anti-microbial peptide
KRRWPWWPWKKLI

SEQ ID NO: 2556 - protein, 38 aa, Unknown
  Description of Unknown: Anti-microbial peptide
MPRWRLFRRIDRVGKQIKQGILRAGPAIALVGDARAVG

SEQ ID NO: 2557 - protein, 7 aa, Unknown
  Description of Unknown: Anti-microbial peptide
TGRAKRR

SEQ ID NO: 2558 - protein, 42 aa, Unknown
  Description of Unknown: Anti-microbial peptide
RRVVRRVRRVVRRVVRVVRRVVRRVRRVVRRVVRVVRRVVRR

SEQ ID NO: 2559 - protein, 26 aa, Unknown
  Description of Unknown: Anti-microbial peptide
KWKEFIKKLTTAVKKVLTTGLPALIS

SEQ ID NO: 2560 - protein, 40 aa, Unknown; identical to SEQ ID NO: 1019
  Description of Unknown: Anti-microbial peptide

SEQ ID NO: 2561 - protein, 18 aa, Unknown
  Description of Unknown: Anti-microbial peptide
KNIRRIIRKIIHIIKKYG

SEQ ID NO: 2562 - protein, 16 aa, Unknown
  Description of Unknown: Anti-microbial peptide
DGPKKKKKKSPSKSSK

SEQ ID NO: 2563 - protein, 68 aa, Unknown
  Description of Unknown: Anti-microbial peptide
KFAKKFAKKFAKKFAKKFAKKFAKKFAKKFAKKFAKKFAKKFAKKFAKKFAKKFAKKFAKKFAKKFAK

SEQ ID NO: 2564 - protein, 8 aa, Unknown
  Description of Unknown: Anti-microbial peptide
  MOD_RES (4)..(5): Any amino acid
VPKXXKPV

SEQ ID NO: 2565 - protein, 18 aa, Unknown
  Description of Unknown: Anti-microbial peptide
GICYCICGRGICRCICGR

SEQ ID NO: 2566 - protein, 15 aa, Unknown
  Description of Unknown: Anti-microbial peptide
RAIRRAIRGAPRAIL

SEQ ID NO: 2567 - protein, 13 aa, Unknown
  Description of Unknown: Anti-microbial peptide
NYVFPAHKCICYF

SEQ ID NO: 2568 - protein, 10 aa, Unknown
  Description of Unknown: Anti-microbial peptide
RLWVWWVWRR

SEQ ID NO: 2569 - protein, 52 aa, Unknown
  Description of Unknown: Anti-microbial peptide
ERLYLRDEINTVFSMLVSVAKKRFRRAVKRNRVRRLVRELDVLLPDFRTVER

SEQ ID NO: 2570 - protein, 71 aa, Unknown
  Description of Unknown: Anti-microbial peptide
LRLLTPEHYQKVFRLGLAVPKKQIKTAVGRNRFKRICRESFRLHQNQLDFVVIAKKSAQDLSNEELFNLLG

SEQ ID NO: 2571 - protein, 106 aa, Unknown
  Description of Unknown: Anti-microbial peptide
MAMAKVFCVLLLALLGISMITTQVMATDSAYHLDGRNYGPGSLKSSQCPSECTRRCSQTQYHKPCMVFCKQCCKRCLCVPPGYYGNKSVCPCYNNWKTKRGGPKCP

SEQ ID NO: 2572 - protein, 141 aa, Unknown
  Description of Unknown: Anti-microbial peptide
VTPAMRTFALLTAMLLLVALAQAEPLQARADEAAAQEQPGADDQEMAHAFTWDESAALPLSDSARGLRCIGGRGICGLLQRRFGSCAFRGTLHRICCRACRIKKNKLRIYSESKKFLLLLYLVLHFLFSSKINTLLQDFSL

SEQ ID NO: 2573 - protein, 19 aa, Unknown
  Description of Unknown: Anti-microbial peptide
RAIRRAIRGAPRAILRAIL

SEQ ID NO: 2574 - protein, 14 aa, Unknown
  Description of Unknown: Anti-microbial peptide
IRLEKARHGSCNYV

SEQ ID NO: 2575 - protein, 10 aa, Unknown
  Description of Unknown: Anti-microbial peptide
WVRLWWRRVW

SEQ ID NO: 2576 - protein, 49 aa, Unknown
  Description of Unknown: Anti-microbial peptide
LRGEREFRRIGLVVSKKTLKHAVKRNRARRRVRELLRAILLAQALQRGA

SEQ ID NO: 2577 - protein, 71 aa, Unknown
  Description of Unknown: Anti-microbial peptide
KRLLTARQFSAVFRLGLVIGKKNVKLAVQRNRLKRLIRESFRHNQETLDIVVIARKGLGELENPELHQQFG

SEQ ID NO: 2578 - protein, 141 aa, Unknown
  Description of Unknown: Anti-microbial peptide
VTPAMRTFALLTAMLLLVALAQAEPLQARADEAAAQEQPGADDQEMAHAFTWDESAALPLSDSARGLRCIGGRGICGLLQRRVGSCAFRGTLHRICCRACRIKKNKLRIYSESKKFLLLLYLVLHFLFSSKINTSLQDFSL

SEQ ID NO: 2579 - protein, 28 aa, Unknown
  Description of Unknown: Anti-microbial peptide
KVIEVVQGACKAIKHIPKKIKQGLEKIL

SEQ ID NO: 2580 - protein, 14 aa, Unknown
  Description of Unknown: Anti-microbial peptide
RLEKARHGSCNYVF

SEQ ID NO: 2581 - protein, 12 aa, Unknown
  Description of Unknown: Anti-microbial peptide
IKKWPWWPWRRK

SEQ ID NO: 2582 - protein, 97 aa, Unknown
  Description of Unknown: Anti-microbial peptide
MAARSYSPIMVALSLLLLVTFSNVAEAYTRSGTLRPSDCKPKCTYRCSATSHKKPCMFFCQKCCAKCLCVPPGTYGNKQICPCYNSWKTKEGGPKCP

SEQ ID NO: 2583 - protein, 49 aa, Unknown
  Description of Unknown: Anti-microbial peptide
ARLKGGFLRVLFTVGKKLVPRAVDRNRIKRLMRELTDHQVLERFRAIRH

SEQ ID NO: 2584 - protein, 71 aa, Unknown
  Description of Unknown: Anti-microbial peptide
LRLLTPAQFKSVFRLGLTVAKRYVKRANQRNRIKRVIRDSFRLNQHNIDIVVLVRNGVMEMENAELNGLIE

SEQ ID NO: 2585 - protein, 97 aa, Unknown; identical to SEQ ID NO: 2582
  Description of Unknown: Anti-microbial peptide

SEQ ID NO: 2586 - protein, 141 aa, Unknown
  Description of Unknown: Anti-microbial peptide
  MOD_RES (113)..(113): Any amino acid
VTPAMRTFALLTAMLLLVALHAQAEARQARADEAAAQQQPGADDQGMAHSFTRPENAALPLSESARGLRCLCRRGVCQLLRRLGSCAFRGLCRICCRASRIKKNTLRSYFESXKKFLLLLYLVLNFLFSSQINTFSQDFCL

SEQ ID NO: 2587 - protein, 14 aa, Unknown
  Description of Unknown: Anti-microbial peptide
LEKARHGSCNYVFP

SEQ ID NO: 2588 - protein, 12 aa, Unknown
  Description of Unknown: Anti-microbial peptide
ILKKPWWPWRRK

SEQ ID NO: 2589 - protein, 46 aa, Unknown
  Description of Unknown: Anti-microbial peptide
NRLKKNEDFQRVGLSVSKKIGNAVMRNRIKRLIRQLKDYIITKKSL

SEQ ID NO: 2590 - protein, 71 aa, Unknown
  Description of Unknown: Anti-microbial peptide
WRIRTTAEFRRIYRLGVVASKRNVRKAVWRNRVRRVVKEAFRIRKKDLDIVVVAKASSVEADNKELYECIN

SEQ ID NO: 2591 - protein, 66 aa, Unknown
  Description of Unknown: Anti-microbial peptide
HEVQHIDCNAACAARCRLASRQRMCHRACGTCCRRCNCVPPGTSGNQEVCPCYASLATHGGRRKCP

SEQ ID NO: 2592 - protein, 141 aa, Unknown
  Description of Unknown: Anti-microbial peptide
  MOD_RES (113)..(113): Any amino acid
VTPAMRTFALLTAMLLLVALHAQAEARQARADEAAAQQQPGADDQGMAHSFTRPENAALPLSESARGLRCICRRGVCQLLRRLGSCAFRGLCRICCRASRIKKNTLRSYFESXKKFLLLLYLVLNFLFSSQINTFSQDFCL

SEQ ID NO: 2593 - protein, 28 aa, Unknown
  Description of Unknown: Anti-microbial peptide
DLWETLRRIIRWILAIPRRIRQGLELTL

SEQ ID NO: 2594 - protein, 14 aa, Unknown
  Description of Unknown: Anti-microbial peptide
EKARHGSCNYVFPA

SEQ ID NO: 2595 - protein, 12 aa, Unknown
  Description of Unknown: Anti-microbial peptide
ILKKWWWPWRRK

SEQ ID NO: 2596 - protein, 45 aa, Unknown
  Description of Unknown: Anti-microbial peptide
HRIKRSDEFSRVLSVSKKIGNAVTRNRVKRLIRTISDYVIVKGSL

SEQ ID NO: 2597 - protein, 70 aa, Unknown
  Description of Unknown: Anti-microbial peptide
TSLKNQKEFELINLGIKVSRKLNKKAVVRNKIKRRIRHLMRIIVNDSAIIIIPKKGFEEINFSHLQYELS

SEQ ID NO: 2598 - protein, 88 aa, Unknown
  Description of Unknown: Anti-microbial peptide
MKLFLLTLLLVTLVITPSLIQTTMAGSNFCDSKCKLRCSKAGLADRCLKYCGVCCEECKCVPSGTYGNKHECPCYRDKKNSKGKSKCP

SEQ ID NO: 2599 - protein, 28 aa, Unknown
  Description of Unknown: Anti-microbial peptide
DLWETLRRGGRWILAIPRRIRQGLELCL

SEQ ID NO: 2600 - protein, 14 aa, Unknown
  Description of Unknown: Anti-microbial peptide
KARHGSCNYVFPAH

SEQ ID NO: 2601 - protein, 12 aa, Unknown
  Description of Unknown: Anti-microbial peptide
ILKKWPWWWRRK

SEQ ID NO: 2602 - protein, 46 aa, Unknown
  Description of Unknown: Anti-microbial peptide
HRIKKNDEFQRIGLSVSKKIGNAVVRNRIKRMIRQIDDFVILKKSL

SEQ ID NO: 2603 - protein, 73 aa, Unknown
  Description of Unknown: Anti-microbial peptide
ERLRKRPDFLLAARVGFTATKKIGGAVERNRAKRRLREAARLVLPLDYVFIARGGTGTREWARLLDDVKTALI

SEQ ID NO: 2604 - protein, 63 aa, Unknown
  Description of Unknown: Anti-microbial peptide
SKINCGAACKARCRLSSRPNLCHRACGTCCARCRCVPPGTSGNQKVCPCYYNMTTHGGRRKCP

SEQ ID NO: 2605 - protein, 9 aa, Unknown
  Description of Unknown: Anti-microbial peptide
RCLCGRRIC

SEQ ID NO: 2606 - protein, 28 aa, Unknown
  Description of Unknown: Anti-microbial peptide
DLWETLRRGCRWILAIPRRIRQGLELTL

SEQ ID NO: 2607 - protein, 14 aa, Unknown
  Description of Unknown: Anti-microbial peptide
ARHGSCNYVFPAHK

SEQ ID NO: 2608 - protein, 12 aa, Unknown
  Description of Unknown: Anti-microbial peptide
ILKKWPWWPRRK

SEQ ID NO: 2609 - protein, 46 aa, Unknown
  Description of Unknown: Anti-microbial peptide
RVIKKNFEFQKYGISVGKKIGNAVIRNKVKRQIRMIGDIIILSKLL

SEQ ID NO: 2610 - protein, 74 aa, Unknown
  Description of Unknown: Anti-microbial peptide
DSLKNKSEFDRVYKLGLSVSKKVGNAVKRNLIKRRLRSLTLKHAALCALVFVPRSDCYHLDFWALEKHFLEMLT

SEQ ID NO: 2611 - protein, 63 aa, Unknown
  Description of Unknown: Anti-microbial peptide
KSYQCGGQCTRRCSNTKYHKPCMFFCQKCCAKCLCVPPGTYGNKQVCPCYNNWKTQQGGPKCP

SEQ ID NO: 2612 - protein, 9 aa, Unknown
  Description of Unknown: Anti-microbial peptide
RCICRRRIC

SEQ ID NO: 2613 - protein, 28 aa, Unknown
  Description of Unknown: Anti-microbial peptide
DLWETLRRIIRWILAIPRRIRQGLELCL

SEQ ID NO: 2614 - protein, 14 aa, Unknown
  Description of Unknown: Anti-microbial peptide
RHGSCNYVFPAHKC

SEQ ID NO: 2615 - protein, 12 aa, Unknown
  Description of Unknown: Anti-microbial peptide
ILKKWPWWPWRR

SEQ ID NO: 2616 - protein, 47 aa, Unknown
  Description of Unknown: Anti-microbial peptide
HHLRDRKVFARAAVSISKTKYKLAVERNLIRRQVKALNDVLVKQTIF

SEQ ID NO: 2617 - protein, 74 aa, Unknown
  Description of Unknown: Anti-microbial peptide
DSLKNKSEFDRVYKLGLSVSKKVGNAVKRNLIKRRLRSLVTRHAALCALVFVPRSDCYHLDFWALEKHFLEMLT

SEQ ID NO: 2618 - protein, 64 aa, Unknown
  Description of Unknown: Anti-microbial peptide
LRPTDCKPRCTYRCSATSHKKPCMFFCQKCCATCLCVPKGVYGNKQSCPCYNNWKTQEGKPKCP

SEQ ID NO: 2619 - protein, 9 aa, Unknown
  Description of Unknown: Anti-microbial peptide
RCICTRRIC

SEQ ID NO: 2620 - protein, 27 aa, Unknown
  Description of Unknown: Anti-microbial peptide
LWETLRRGGRWILAIPRRIRQGLELTL

SEQ ID NO: 2621 - protein, 14 aa, Unknown
  Description of Unknown: Anti-microbial peptide
HGSCNYVFPAHKCI

SEQ ID NO: 2622 - protein, 11 aa, Unknown
  Description of Unknown: Anti-microbial peptide
ILKKWPWWPWK

SEQ ID NO: 2623 - protein, 47 aa, Unknown
  Description of Unknown: Anti-microbial peptide
HSLRERKVFTRVAISIAKTKYKLAVQRNLIKRQIRSLEDILVKQKLF

SEQ ID NO: 2624 - protein, 74 aa, Unknown
  Description of Unknown: Anti-microbial peptide
DKFSTNEEFSSVYKIAVVASKKVGKAVVRNRSKRILRALFAKFERYLKYIFVAKNEITELSFSRLEKNLKWGLK

SEQ ID NO: 2625 - protein, 99 aa, Unknown
  Description of Unknown: Anti-microbial peptide
IFLLTLIVLFMLQTMVMASSGSNVKWSQKRYGPGSLKRTQCPSECDRRCKKTQYHKACITFCNKCCRKCLCVPPGYYGNKQVCSCYNNWKTQEGGPKCP

SEQ ID NO: 2626 - protein, 9 aa, Unknown
  Description of Unknown: Anti-microbial peptide
RCICVRRIC

SEQ ID NO: 2627 - protein, 27 aa, Unknown
  Description of Unknown: Anti-microbial peptide
LWETLRRGGRWILAIPRRIRQGLELCL

SEQ ID NO: 2628 - protein, 14 aa, Unknown
  Description of Unknown: Anti-microbial peptide
GSCNYVFPAHKCIC

SEQ ID NO: 2629 - protein, 11 aa, Unknown
  Description of Unknown: Anti-microbial peptide
ILKKWPWWPWR

SEQ ID NO: 2630 - protein, 44 aa, Unknown
  Description of Unknown: Anti-microbial peptide
VKREKDFQRVGISVGKKIGNAVTRNAVKRKIRHLKDFVVLQQNL

SEQ ID NO: 2631 - protein, 71 aa, Unknown
  Description of Unknown: Anti-microbial peptide
YRLLKTDDFSSVFRIGLVVGKKTAKRANERNYMKRVIRDWFRLNKNRLDFVVRVRRKFDRATAKQARAELA

SEQ ID NO: 2632 - protein, 99 aa, Unknown
  Description of Unknown: Anti-microbial peptide
IFLLTLIVLFMLQTMVMASSGSNVKWRQKRYGPGSLKRTQCPSECDRRCKKTQYHKACITFCNKCCRKCLCVPPGYYGNKQVCSCYNNWKTQEGGPKCP

SEQ ID NO: 2633 - protein, 9 aa, Unknown
  Description of Unknown: Anti-microbial peptide
RCICGLRIC

SEQ ID NO: 2634 - protein, 41 aa, Unknown
  Description of Unknown: Anti-microbial peptide
QRAVGWLRRIGRRIERVGQHLRALAGPGVTIGIAHAKSQLW

SEQ ID NO: 2635 - protein, 17 aa, Unknown
  Description of Unknown: Anti-microbial peptide
VVQGACRAIRHIPRRIR

SEQ ID NO: 2636 - protein, 7 aa, Unknown
  Description of Unknown: Anti-microbial peptide
HPQYAQR

SEQ ID NO: 2637 - protein, 44 aa, Unknown
  Description of Unknown: Anti-microbial peptide
FTQGVRNSQSCRRNKGICVPIRCPGSMRQIGTCLGAQVKCCRRK

SEQ ID NO: 2638 - protein, 18 aa, Unknown
  Description of Unknown: Anti-microbial peptide
MASRAAGLARRLARLARR

SEQ ID NO: 2639 - protein, 15 aa, Unknown
  Description of Unknown: Anti-microbial peptide
ILPWKWPWWPWKKWK

SEQ ID NO: 2640 - protein, 36 aa, Unknown; identical to SEQ ID NO: 897
  Description of Unknown: Anti-microbial peptide

SEQ ID NO: 2641 - protein, 18 aa, Unknown
  Description of Unknown: Anti-microbial peptide
KNLRRAIRKIIHIIKKYG

SEQ ID NO: 2642 - protein, 6 aa, Unknown
  Description of Unknown: Anti-microbial peptide
HKCICY

SEQ ID NO: 2643 - protein, 18 aa, Unknown
  Description of Unknown: Anti-microbial peptide
GKWKAFKKAAKKFAKKCS

SEQ ID NO: 2644 - protein, 14 aa, Unknown
  Description of Unknown: Anti-microbial peptide
KRLFKKLLFSLRKY

SEQ ID NO: 2645 - protein, 10 aa, Unknown
  Description of Unknown: Anti-microbial peptide
NVGFYKKFDY

SEQ ID NO: 2646 - protein, 14 aa, Unknown
  Description of Unknown: Anti-microbial peptide
KLYKKWKKKLLKLK

SEQ ID NO: 2647 - protein, 18 aa, Unknown
  Description of Unknown: Anti-microbial peptide
RVWCRRRCYRGFCRYFCR

SEQ ID NO: 2648 - protein, 10 aa, Unknown
  Description of Unknown: Anti-microbial peptide
SYKCLHKRCR

SEQ ID NO: 2649 - protein, 31 aa, Unknown
  Description of Unknown: Anti-microbial peptide
KWKFKKIGIGAVLKVLKVLTTGLPALKLTLK

SEQ ID NO: 2650 - protein, 13 aa, Unknown
  Description of Unknown: Anti-microbial peptide
ILKKFPFFPFRRK

SEQ ID NO: 2651 - protein, 18 aa, Unknown
  Description of Unknown: Anti-microbial peptide
FVNVVPTFGKKKGPNANS

SEQ ID NO: 2652 - protein, 48 aa, Unknown
  Description of Unknown: Anti-microbial peptide
RVVRVVRRVVRRVRRVVRRVVRVVRRVVRRVRRVVRRVVRVVRRVVRR

SEQ ID NO: 2653 - protein, 26 aa, Unknown
  Description of Unknown: Anti-microbial peptide
KWKKFIKELQKVLAPGGLLSNIVTSL

SEQ ID NO: 2654 - protein, 18 aa, Unknown
  Description of Unknown: Anti-microbial peptide
KNLRRIIRKIIHIIKKYG

SEQ ID NO: 2655 - protein, 14 aa, Unknown
  Description of Unknown: Anti-microbial peptide
SKDGKKKKKKSKTK

SEQ ID NO: 2656 - protein, 84 aa, Unknown
  Description of Unknown: Anti-microbial peptide
KFAKKFAKKFAKKFAKKFAKKFAKKFAKKFAKKFAKKFAKKFAKKFAKKFAKKFAKKFAKKFAKKFAKKFAKKFAKKFAKKFAK

SEQ ID NO: 2657 - protein, 18 aa, Unknown
  Description of Unknown: Anti-microbial peptide
GICICICGYGICRCICGR

SEQ ID NO: 2658 - protein, 27 aa, Unknown
  Description of Unknown: Anti-microbial peptide
LWETLRRGCRWILAIPRRIRQGLELTL

SEQ ID NO: 2659 - protein, 14 aa, Unknown
  Description of Unknown: Anti-microbial peptide
SCNYVFPAHKCICY

SEQ ID NO: 2660 - protein, 10 aa, Unknown
  Description of Unknown: Anti-microbial peptide
LWPWWPWRRK

SEQ ID NO: 2661 - protein, 78 aa, Unknown
  Description of Unknown: Anti-microbial peptide
SVSNLVQAARGGGKLKPQQCNSKCSYRCSATSHKKPCMFFCLKCCKKCLCVPPGTFGNKQTCPCYNNWKTKEGRPKCP

SEQ ID NO: 2662 - protein, 46 aa, Unknown
  Description of Unknown: Anti-microbial peptide
YRVKSDKDFQRVGLSVGKRLGNAVVRNAIKRKLRHLGDFVVMKKNL

SEQ ID NO: 2663 - protein, 71 aa, Unknown
  Description of Unknown: Anti-microbial peptide
YRLLKTDDFSSVFRIGLVVGEKTAKRANERNYMKRVIRDWFRLNKNRLDFVVRVRRKFDRATAKQARAELA

SEQ ID NO: 2664 - protein, 78 aa, Unknown; identical to SEQ ID NO: 2661
  Description of Unknown: Anti-microbial peptide

SEQ ID NO: 2665 - protein, 9 aa, Unknown
  Description of Unknown: Anti-microbial peptide
RCICGRRVC

SEQ ID NO: 2666 - protein, 27 aa, Unknown
  Description of Unknown: Anti-microbial peptide
LWRTLRRGGRWILAIPRRIRQGLELTL

SEQ ID NO: 2667 - protein, 14 aa, Unknown
  Description of Unknown: Anti-microbial peptide
CNYVFPAHKCICYF

SEQ ID NO: 2668 - protein, 10 aa, Unknown
  Description of Unknown: Anti-microbial peptide
LRWWWPWRRK

SEQ ID NO: 2669 - protein, 46 aa, Unknown
  Description of Unknown: Anti-microbial peptide
FRVKREKDFKRVGLSVSKKLGNAVTRNQIKRRIRHLVDFVVMEKNL

SEQ ID NO: 2670 - protein, 75 aa, Unknown
  Description of Unknown: Anti-microbial peptide
ARLHRPSEFAAALRLGLVIAKRFAARAVTRNTLKRVIREAFRARRLALDYVVRLHSKLTPASLTALKRSARAEVD

SEQ ID NO: 2671 - protein, 66 aa, Unknown
  Description of Unknown: Anti-microbial peptide
GRLHPQDCQPKCTYRCSKTSYKKPCMFFCQKCCAKCLCVPAGTYGNKQSCPCYNNWKTKRGGPKCP

SEQ ID NO: 2672 - protein, 27 aa, Unknown
  Description of Unknown: Anti-microbial peptide
LWETLRRGGRWILAIPRRIRQGLRLTL

SEQ ID NO: 2673 - protein, 15 aa, Unknown
  Description of Unknown: Anti-microbial peptide
IRLEKARHGSCNYVF

SEQ ID NO: 2674 - protein, 8 aa, Unknown
  Description of Unknown: Anti-microbial peptide
LRWPWWPW

SEQ ID NO: 2675 - protein, 46 aa, Unknown
  Description of Unknown: Anti-microbial peptide
YRIKKNADFQRLGISVSKKLGNAVLRNKIKRAIREILDIIVIQNSL

SEQ ID NO: 2676 - protein, 70 aa, Unknown
  Description of Unknown: Anti-microbial peptide
DRLRQKVAIQRTLRLGLAVSRKVGNAVVRNRIKRRLREAFRQQSVRTDVLVVARPSARQLSMRAMGAYLQ

SEQ ID NO: 2677 - protein, 74 aa, Unknown
  Description of Unknown: Anti-microbial peptide
AAEDSQVGEGVVKIDCGGRCKGRCSKSSRPNLCLRACNSCCYRCNCVPPGTAGNHHLCPCYASITTRGGRLKCP

SEQ ID NO: 2678 - protein, 27 aa, Unknown
  Description of Unknown: Anti-microbial peptide
LWETLRRGGRWILAIPRRIRRGLELTL

SEQ ID NO: 2679 - protein, 15 aa, Unknown
  Description of Unknown: Anti-microbial peptide
RLEKARHGSCNYVFP

SEQ ID NO: 2680 - protein, 9 aa, Unknown
  Description of Unknown: Anti-microbial peptide
WPWWPWRRK

SEQ ID NO: 2681 - protein, 70 aa, Unknown
  Description of Unknown: Anti-microbial peptide
NRLRRREDFATAVRAGFVVSKAVGGAVVRNQVKRRLKHLVCDRLSALLVVVRALPGAGDADHAQLARDLD

SEQ ID NO: 2682 - protein, 80 aa, Unknown
  Description of Unknown: Anti-microbial peptide
YELHVHAADGAKVGEGVVKIDCGGRCKDRCSKSSRTKLCLRACNSCCSRCNCVPPGTSGNTHLCPCYASITTHGGRLKCP

SEQ ID NO: 2683 - protein, 9 aa, Unknown
  Description of Unknown: Anti-microbial peptide
RCLCTRRIC

SEQ ID NO: 2684 - protein, 27 aa, Unknown
  Description of Unknown: Anti-microbial peptide
LWETLRRGGRWILAIPRRIRRQIELTL

SEQ ID NO: 2685 - protein, 15 aa, Unknown
  Description of Unknown: Anti-microbial peptide
LEKARHGSCNYVFPA

SEQ ID NO: 2686 - protein, 64 aa, Unknown
  Description of Unknown: Anti-microbial peptide
MRVLYLLFSFLFIFLMPLPGVFGGISDPVTCLKSGAICHPVFCPRRYKQIGTCGLPGTKCCKKP

SEQ ID NO: 2687 - protein, 9 aa, Unknown
  Description of Unknown: Anti-microbial peptide
RWWWPWRRK

SEQ ID NO: 2688 - protein, 46 aa, Unknown
  Description of Unknown: Anti-microbial peptide
KGLKKDSDFRRVGISVSKKVGKAITRNRVRRLIKEKIKDIVFIKNL

SEQ ID NO: 2689 - protein, 70 aa, Unknown
  Description of Unknown: Anti-microbial peptide
NRLRRREDFATAVRAGFVVSKAVGVAVVRNKVKRRLRHLMRDRIDLLLVVVRALPGAGDADHAQLARDLD

SEQ ID NO: 2690 - protein, 76 aa, Unknown
  Description of Unknown: Anti-microbial peptide
ADVESSQKKNGYAKKIDCGSACVARCRLSRRPRLCHRACGTCCYRCNCVPPGTYGNYDKCQCYASLTTHGGRRKCP

SEQ ID NO: 2691 - protein, 9 aa, Unknown
  Description of Unknown: Anti-microbial peptide
RCLCVRRIC

SEQ ID NO: 2692 - protein, 27 aa, Unknown
  Description of Unknown: Anti-microbial peptide
LWELLRRGGRWILAIPRRIRQGLELTL

SEQ ID NO: 2693 - protein, 64 aa, Unknown
  Description of Unknown: Anti-microbial peptide
MRVLYLLFSFLFIFLMPLPGVFGGIGDPVTCLKSGAICHPVFCPRRYKQIGTCGLPGTKCCKKP

SEQ ID NO: 2694 - protein, 12 aa, Unknown
  Description of Unknown: Anti-microbial peptide
ALRWPWWPWRRK

SEQ ID NO: 2695 - protein, 47 aa, Unknown
  Description of Unknown: Anti-microbial peptide
LRLKHWQDFQRFGITVSQKVSKKATVRNRLKRQIRAIKDVVIFLREL

SEQ ID NO: 2696 - protein, 74 aa, Unknown
  Description of Unknown: Anti-microbial peptide
RRVRTPAEFRHLGRAGFVVSKAVGNAVTRNRVKRRLRAVVAEQMRLVLVQVRALPAAAEADYALLRRETVGALG

SEQ ID NO: 2697 - protein, 66 aa, Unknown
  Description of Unknown: Anti-microbial peptide
GSLHPQDCQPKCTYRCSKTSFKKPCMFFCQKCCAKCLCVPAGTYGNKQTCPCYNNWKTKEGGPKCP

SEQ ID NO: 2698 - protein, 27 aa, Unknown
  Description of Unknown: Anti-microbial peptide
LWRLLRRGGRWILAIPRRIRQGLELTL

SEQ ID NO: 2699 - protein, 15 aa, Unknown
  Description of Unknown: Anti-microbial peptide
KARHGSCNYVFPAHK

SEQ ID NO: 2700 - protein, 12 aa, Unknown
  Description of Unknown: Anti-microbial peptide
IARWPWWPWRRK

SEQ ID NO: 2701 - protein, 47 aa, Unknown
  Description of Unknown: Anti-microbial peptide
NRLRRREDFARIGIVVSKKVSKLAVTRNRFKRQLRALKQIVVLGDDL

SEQ ID NO: 2702 - protein, 71 aa, Unknown
  Description of Unknown: Anti-microbial peptide
NRMRRSADFETTVRVGLIIAKSVGSAVERHRVARRLRHVAGSIVKELDHVVIRALPSSRHVSSARLEQQLR

SEQ ID NO: 2703 - protein, 76 aa, Unknown
  Description of Unknown: Anti-microbial peptide
LVTSAGKGNSSPKKIDCGGACAARCQLSSRPHLCKRACGTCCARCACVPPGTAGNQEMCPKCYASLTTHGGKRKCP

SEQ ID NO: 2704 - protein, 21 aa, Unknown
  Description of Unknown: Anti-microbial peptide
DLWETLRRIIRWILAIPRRIR

SEQ ID NO: 2705 - protein, 15 aa, Unknown
  Description of Unknown: Anti-microbial peptide
ARHGSCNYVFPAHKC

SEQ ID NO: 2706 - protein, 36 aa, Unknown; identical to SEQ ID NO: 896
  Description of Unknown: Anti-microbial peptide

SEQ ID NO: 2707 - protein, 12 aa, Unknown
  Description of Unknown: Anti-microbial peptide
ILAWPWWPWRRK

SEQ ID NO: 2708 - protein, 46 aa, Unknown
  Description of Unknown: Anti-microbial peptide
ISLKSKIEIQRILVTFSKGFRGSVKRNRIRRLFKELEDIIFIESLM

SEQ ID NO: 2709 - protein, 71 aa, Unknown
  Description of Unknown: Anti-microbial peptide
NRMRRSSEFDATVHVGLIIAKTVGSAVERHRVARRLRHVARTMLGELDQVVIRALPSSRNVSSAWLAQQLR

SEQ ID NO: 2710 - protein, 90 aa, Unknown
  Description of Unknown: Anti-microbial peptide
MMISLLVFNPVEADGVVVNYGQHASLLAKIDCGGACKARCRLSSRPHLCKRACGTCCQRCSCVPPGTAGNYDVCPCYATLTTHGGKRKCP

SEQ ID NO: 2711 - protein, 9 aa, Unknown
  Description of Unknown: Anti-microbial peptide
RCLCGRRFC

SEQ ID NO: 2712 - protein, 21 aa, Unknown
  Description of Unknown: Anti-microbial peptide
DLWETLRRGGRWILAIPRRIR

SEQ ID NO: 2713 - protein, 15 aa, Unknown
  Description of Unknown: Anti-microbial peptide
RHGSCNYVFPAHKCI

SEQ ID NO: 2714 - protein, 36 aa, Unknown
  Description of Unknown: Anti-microbial peptide
NHRSCYRNKGVCAPARCPRNMRQIGTCHGPPVKCCR

SEQ ID NO: 2715 - protein, 12 aa, Unknown
  Description of Unknown: Anti-microbial peptide
ILRAPWWPWRRK

SEQ ID NO: 2716 - protein, 46 aa, Unknown
  Description of Unknown: Anti-microbial peptide
ERLRGSCRVRRFLATFRRGYGKAVARNRARRLSKELVDLVLLLCVL

SEQ ID NO: 2717 - protein, 75 aa, Unknown
  Description of Unknown: Anti-microbial peptide
LVTSASKGSSFPKKIDCGGACAARCQLSSRPHLCKRACGTCCARSRCVPPGTAGNQEMCPCYASLTTHGGKRKCP

SEQ ID NO: 2718 - protein, 9 aa, Unknown
  Description of Unknown: Anti-microbial peptide
RCICRRRVC

SEQ ID NO: 2719 - protein, 21 aa, Unknown
  Description of Unknown: Anti-microbial peptide
DLWETLRRGCRWILAIPRRIR

SEQ ID NO: 2720 - protein, 12 aa, Unknown
  Description of Unknown: Anti-microbial peptide
ILRWAWWPWRRK

SEQ ID NO: 2721 - protein, 101 aa, Unknown
  Description of Unknown: Anti-microbial peptide
YEFREIKFFFLCVYVQGDELESQAQAPAIHKNGGEGSLKPEECPKACEYRCSATSHRKPCLFFCNKCCNKCLCVPSGTYGHKEECPCYNNWTTKEGGPKCP

SEQ ID NO: 2722 - protein, 49 aa, Unknown
  Description of Unknown: Anti-microbial peptide
ARLLKRKQFVKVGITVSKKFGKAHQRNRFKRIVRELQVVILSEELLQRI

SEQ ID NO: 2723 - protein, 71 aa, Unknown
  Description of Unknown: Anti-microbial peptide
NRMTRSTEFDATVRVGLVVGKAVGTAVQRHRVARRLRHVARALLGELDRLVIRALPGSRTASSARLAQELQ

SEQ ID NO: 2724 - protein, 101 aa, Unknown; identical to SEQ ID NO: 2721
  Description of Unknown: Anti-microbial peptide

SEQ ID NO: 2725 - protein, 9 aa, Unknown
  Description of Unknown: Anti-microbial peptide
RCICRRRFC

SEQ ID NO: 2726 - protein, 23 aa, Unknown
  Description of Unknown: Anti-microbial peptide
SKMIEGVFAKGFKGASHLFKGIG

SEQ ID NO: 2727 - protein, 31 aa, Unknown
  Description of Unknown: Anti-microbial peptide
RRIYRAIRHIPRRIRGWLRRIGRRIERVGQH

SEQ ID NO: 2728 - protein, 14 aa, Unknown
  Description of Unknown: Anti-microbial peptide
GACRAIRHIPRRIR

SEQ ID NO: 2729 - protein, 7 aa, Unknown
  Description of Unknown: Anti-microbial peptide
HPQYNQA

SEQ ID NO: 2730 - protein, 19 aa, Unknown
  Description of Unknown: Anti-microbial peptide
MASRAAGLARRLARLARRA

SEQ ID NO: 2731 - protein, 80 aa, Unknown
  Description of Unknown: Anti-microbial peptide
MKTTILILLILGLGINAKSLEERKSEEEKLFKLLGKIIHHVGNFVHGFSHVFGDDQQDNGKFYGYYAEDNGKHWYDTGDQ

SEQ ID NO: 2732 - protein, 25 aa, Unknown
  Description of Unknown: Anti-microbial peptide
NQGRHFCGGALIHARFVMTAAHCFQ

SEQ ID NO: 2733 - protein, 11 aa, Unknown
  Description of Unknown: Anti-microbial peptide
PWKWPWWPWRR

SEQ ID NO: 2734 - protein, 40 aa, Unknown; identical to SEQ ID NO: 36
  Description of Unknown: Anti-microbial peptide

SEQ ID NO: 2735 - protein, 9 aa, Unknown
  Description of Unknown: Anti-microbial peptide
QCIRLEKAR

SEQ ID NO: 2736 - protein, 19 aa, Unknown
  Description of Unknown: Anti-microbial peptide
IKISGKWKAQKRFLKMSGC

SEQ ID NO: 2737 - protein, 14 aa, Unknown
  Description of Unknown: Anti-microbial peptide
LLLFLLKKRKKRKY

SEQ ID NO: 2738 - protein, 20 aa, Unknown
  Description of Unknown: Anti-microbial peptide
RHFSGGALIHARFVMTAASS

SEQ ID NO: 2739 - protein, 20 aa, Unknown
  Description of Unknown: Anti-microbial peptide
LEDFFVMSDYRGFGIGSEIL

SEQ ID NO: 2740 - protein, 13 aa, Unknown
  Description of Unknown: Anti-microbial peptide
ALYKKWKNKLLKS

SEQ ID NO: 2741 - protein, 18 aa, Unknown
  Description of Unknown: Anti-microbial peptide
RVWCRYRCYRGFCRRFCR

SEQ ID NO: 2742 - protein, 8 aa, Unknown
  Description of Unknown: Anti-microbial peptide
KCLHKRCR

SEQ ID NO: 2743 - protein, 33 aa, Unknown
  Description of Unknown: Anti-microbial peptide
KLWKLFKKIGIGAVLKVLKVLTTGLPALKLTLK

SEQ ID NO: 2744 - protein, 13 aa, Unknown
  Description of Unknown: Anti-microbial peptide
ILKKIPIIPIRRK

SEQ ID NO: 2745 - protein, 29 aa, Unknown
  Description of Unknown: Anti-microbial peptide
CYCRIPACIAGERRYGTCIYQGRLWAFCC

SEQ ID NO: 2746 - protein, 6 aa, Unknown
  Description of Unknown: Anti-microbial peptide
MQYNRR

SEQ ID NO: 2747 - protein, 12 aa, Unknown
  Description of Unknown: Anti-microbial peptide
RVVRVVRRWVRR

SEQ ID NO: 2748 - protein, 26 aa, Unknown
  Description of Unknown: Anti-microbial peptide
KWKSFIKKLTSVLKKVVTTALPALIS

SEQ ID NO: 2749 - protein, 22 aa, Unknown
  Description of Unknown: Anti-microbial peptide
GIGKFLHSAGKFGKAFVGEIMK

SEQ ID NO: 2750 - protein, 24 aa, Unknown
  Description of Unknown: Anti-microbial peptide
RFARRFARRFARRFARRFARRFAR

SEQ ID NO: 2751 - protein, 18 aa, Unknown
  Description of Unknown: Anti-microbial peptide
GICICICGRGICYCICGR

SEQ ID NO: 2752 - protein, 15 aa, Unknown
  Description of Unknown: Anti-microbial peptide
GSCNYVFPAHKCICY

SEQ ID NO: 2753 - protein, 12 aa, Unknown
  Description of Unknown: Anti-microbial peptide
ILRWPAWPWRRK

SEQ ID NO: 2754 - protein, 49 aa, Unknown
  Description of Unknown: Anti-microbial peptide
ARLLKRKQFVKVGVTVSKKFGKAHQRNRFKRIVRELQVVVLSADLLKHI

SEQ ID NO: 2755 - protein, 50 aa, Unknown
  Description of Unknown: Anti-microbial peptide
HKLSQFRATIRFGLVVSKAVGNAVTRHRVSRQLRHFHVVELRADVQAALD

SEQ ID NO: 2756 - protein, 59 aa, Unknown
  Description of Unknown: Anti-microbial peptide
CGGKCNVRCSKAGQHEECLKYCNICCQKCNCVPSGTFGHKDECPCYRDMKNSKGGSKCP

SEQ ID NO: 2757 - protein, 9 aa, Unknown
  Description of Unknown: Anti-microbial peptide
RCICTRRVC

SEQ ID NO: 2758 - protein, 15 aa, Unknown
  Description of Unknown: Anti-microbial peptide
SCNYVFPAHKCICYF

SEQ ID NO: 2759 - protein, 12 aa, Unknown
  Description of Unknown: Anti-microbial peptide
ILRWPWAPWRRK

SEQ ID NO: 2760 - protein, 49 aa, Unknown
  Description of Unknown: Anti-microbial peptide
SRVLKRKQFLRMGITVSKKFGKAHERNSFKRVVRELQIVVLLQDFINQI

SEQ ID NO: 2761 - protein, 75 aa, Unknown
  Description of Unknown: Anti-microbial peptide
EQKQGQYGEGSLRPSECGQRCSYRCSATSHKKPCMFFCQKCCAKCLCVPPGTFGNKQVCPCYNNWKTQQGGPKCP

SEQ ID NO: 2762 - protein, 9 aa, Unknown
  Description of Unknown: Anti-microbial peptide
RCICTRRFC

SEQ ID NO: 2763 - protein, 16 aa, Unknown
  Description of Unknown: Anti-microbial peptide
IRLEKARHGSCNYVFP

SEQ ID NO: 2764 - protein, 12 aa, Unknown
  Description of Unknown: Anti-microbial peptide
ILRWPWWAWRRK

SEQ ID NO: 2765 - protein, 70 aa, Unknown
  Description of Unknown: Anti-microbial peptide
QSKDGPALEKWCGQKCEGRCKEAGMKDRCLKYCGICCKDCQCVPSGTYGNKHECACYRDKLSSKGTPKCP

SEQ ID NO: 2766 - protein, 70 aa, Unknown
  Description of Unknown: Anti-microbial peptide
NRLKRSDDFRKVFRVGLSVSKKIGNAVMRNRIKRLIRQFFQEHEQALDYIIIARKPAADMTYEETKKSLQ

SEQ ID NO: 2767 - protein, 70 aa, Unknown; identical to SEQ ID NO: 2765
  Description of Unknown: Anti-microbial peptide

SEQ ID NO: 2768 - protein, 9 aa, Unknown
  Description of Unknown: Anti-microbial peptide
RCICTLRIC

SEQ ID NO: 2769 - protein, 20 aa, Unknown
  Description of Unknown: Anti-microbial peptide
LWETLRRGGRWILAIPRRIR

SEQ ID NO: 2770 - protein, 16 aa, Unknown
  Description of Unknown: Anti-microbial peptide
RLEKARHGSCNYVFPA

SEQ ID NO: 2771 - protein, 12 aa, Unknown
  Description of Unknown: Anti-microbial peptide
ILRWPWWPARRK

SEQ ID NO: 2772 - protein, 69 aa, Unknown
  Description of Unknown: Anti-microbial peptide
HRIKKNDEFSRVFRVLSVSKKIGNAVTRNRVKRLIRTSITELKDEIDYVIIARKPCAEMTYEQVKGSLW

SEQ ID NO: 2773 - protein, 54 aa, Unknown
  Description of Unknown: Anti-microbial peptide
MVRCSLSSRPNLCHRACGTCCARCNCVAPGTSGNYDKCPCYGSLTTHGGRRKEV

SEQ ID NO: 2774 - protein, 20 aa, Unknown
  Description of Unknown: Anti-microbial peptide
LWETLRRGCRWILAIPRRIR

SEQ ID NO: 2775 - protein, 16 aa, Unknown
  Description of Unknown: Anti-microbial peptide
LEKARHGSCNYVFPAH

SEQ ID NO: 2776 - protein, 12 aa, Unknown
  Description of Unknown: Anti-microbial peptide
ILRWPWWPWARK

SEQ ID NO: 2777 - protein, 70 aa, Unknown
  Description of Unknown: Anti-microbial peptide
HRIKKNFEFQTVFRIGLSVSKKIGNAVVRNRIKRMIRQILKQNISEIDFVILVRKSVLELKYAELKKSLI

SEQ ID NO: 2778 - protein, 76 aa, Unknown
  Description of Unknown: Anti-microbial peptide
ADVENSQKKNGYAKKIDCGSACVARCRLSRRPRLCHRACGTCCYRCNCVPPGTYGNYDKCQCYASLTTHGGRRKCP

SEQ ID NO: 2779 - protein, 9 aa, Unknown
  Description of Unknown: Anti-microbial peptide
RCICRLRIC

SEQ ID NO: 2780 - protein, 20 aa, Unknown
  Description of Unknown: Anti-microbial peptide
LWETLRRIIRWILAIPRRIR

SEQ ID NO: 2781 - protein, 16 aa, Unknown
  Description of Unknown: Anti-microbial peptide
EKARHGSCNYVFPAHK

SEQ ID NO: 2782 - protein, 12 aa, Unknown
  Description of Unknown: Anti-microbial peptide
ILRWPWWPWRAK

SEQ ID NO: 2783 - protein, 93 aa, Unknown
  Description of Unknown: Anti-microbial peptide
MKLNTTTTLALLLLLLLASSSLQVSMAGSDFCDGKCKVRCSKASRHDDCLKYCGVCCASCNCVPSGTAGNKDECPCYRDMTTGHGARKRPKCP

SEQ ID NO: 2784 - protein, 70 aa, Unknown
  Description of Unknown: Anti-microbial peptide
RVIKDRKEFQEIIKYGISVGKKIGNAVIRNKVKRQIRMIMREQFCNIDIIIIINQGFLELTFKTLSKLLI

SEQ ID NO: 2785 - protein, 59 aa, Unknown
  Description of Unknown: Anti-microbial peptide
CDGKCKVRCSKASRHDDCLKYCGVCCASCNCVPSGTAGNKDECPCYRDMTTGHGARKRP

SEQ ID NO: 2786 - protein, 9 aa, Unknown
  Description of Unknown: Anti-microbial peptide
RCICVRRVC

SEQ ID NO: 2787 - protein, 20 aa, Unknown
  Description of Unknown: Anti-microbial peptide
LWELLRRGGRWILAIPRRIR

SEQ ID NO: 2788 - protein, 16 aa, Unknown
  Description of Unknown: Anti-microbial peptide
KARHGSCNYVFPAHKC

SEQ ID NO: 2789 - protein, 12 aa, Unknown
  Description of Unknown: Anti-microbial peptide
ILRWPWWPWRRA

SEQ ID NO: 2790 - protein, 71 aa, Unknown
  Description of Unknown: Anti-microbial peptide
HHLRERKVFAALLRAAVSISKTKYKLAVERNLIRRQVKAIFQQISNNLDVLVIVNKGFIELTFKEKQTIFL

SEQ ID NO: 2791 - protein, 106 aa, Unknown
  Description of Unknown: Anti-microbial peptide
MAKSYGAIFLLTLIVLFMLQTMYMASSGSNVKWRQKRVGPGSLKRTQCPSECDRRCKKTQYHKACITFCNKCCRKCLCVPPGYYGNKQVCSCYNNWKTQEGGPKCP

SEQ ID NO: 2792 - protein, 9 aa, Unknown
  Description of Unknown: Anti-microbial peptide
RCICGRRFC

SEQ ID NO: 2793 - protein, 20 aa, Unknown
  Description of Unknown: Anti-microbial peptide
LWRLLRRGGRWILAIPRRIR

SEQ ID NO: 2794 - protein, 16 aa, Unknown
  Description of Unknown: Anti-microbial peptide
ARHGSCNYVFPAHKCI

SEQ ID NO: 2795 - protein, 13 aa, Unknown
  Description of Unknown: Anti-microbial peptide
RRIWKPKWRLPKR

SEQ ID NO: 2796 - protein, 71 aa, Unknown
  Description of Unknown: Anti-microbial peptide
HSLRREKVFTTILRVAISIAKTKYKLAVQRNLIKRQIRSVIMALGHQLDILVIARKGVESLEYQEKQKLFL

SEQ ID NO: 2797 - protein, 18 aa, Unknown
  Description of Unknown: Anti-microbial peptide
  MOD_RES (2)..(3): Any amino acid
  MOD_RES (6)..(10): Any amino acid
  MOD_RES (14)..(18): Any amino acid
CXXCCXXXXXCVPXXXXX

SEQ ID NO: 2798 - protein, 9 aa, Unknown
  Description of Unknown: Anti-microbial peptide
RCICGLRFC

SEQ ID NO: 2799 - protein, 16 aa, Unknown
  Description of Unknown: Anti-microbial peptide
LRRGGRWILAIPRRIR

SEQ ID NO: 2800 - protein, 16 aa, Unknown
  Description of Unknown: Anti-microbial peptide
RHGSCNYVFPAHKCIC

SEQ ID NO: 2801 - protein, 68 aa, Unknown
  Description of Unknown: Anti-microbial peptide
VKSDKDFQAIFRVGISVGKKIGNAVTRNAVKRKIRHVLMELGPYLDFVVIARKGVEELDYSELQQNLH

SEQ ID NO: 2802 - protein, 20 aa, Unknown
  Description of Unknown: Anti-microbial peptide
  MOD_RES (1)..(4): Any amino acid
  MOD_RES (7)..(19): Any amino acid
XXXXCYXXXXXXXXXXXXXK

SEQ ID NO: 2803 - protein, 9 aa, Unknown
  Description of Unknown: Anti-microbial peptide
RCICGLRVC

SEQ ID NO: 2804 - protein, 20 aa, Unknown
  Description of Unknown: Anti-microbial peptide
LWETLRRGGRWILAIPRAIL

SEQ ID NO: 2805 - protein, 16 aa, Unknown
  Description of Unknown: Anti-microbial peptide
HGSCNYVFPAHKCICY

SEQ ID NO: 2806 - protein, 13 aa, Unknown
  Description of Unknown: Anti-microbial peptide
WRWWKPKWRWPKW

SEQ ID NO: 2807 - protein, 70 aa, Unknown
  Description of Unknown: Anti-microbial peptide
YRVKREKDFQAIFRVGLSVGKRLGNAVVRNAIKRKLRHIIQNAKGSLDFVVIARKGVETLGYATMKKNLV

SEQ ID NO: 2808 - protein, 9 aa, Unknown
  Description of Unknown: Anti-microbial peptide
RCLCRLRIC

SEQ ID NO: 2809 - protein, 10 aa, Vigna unguiculata
  subsp. sesquipedalis
KTCENLADTY

SEQ ID NO: 2810 - protein, 36 aa, Bos taurus
DSYICARKGGTCNLSPCPLYNRIEGTCYRGKAKCCI

SEQ ID NO: 2811 - protein, 36 aa, Bos taurus
DSYICARKGGTCNLSPCPLYNRVEGTCYRGKAKCCI

SEQ ID NO: 2812 - protein, 36 aa, Bos taurus; identical to SEQ ID NO: 2810

SEQ ID NO: 2813 - protein, 36 aa, Bos taurus; identical to SEQ ID NO: 2811

SEQ ID NO: 2814 - protein, 23 aa, Phyllomedusa bicolor
PEEMNKYLTALRHYINLVTRQRY

SEQ ID NO: 2815 - protein, 107 aa, Homo sapiens
SGKSFKAGVCPPKKSAQCLRYKKPECQSDWQCPGKKRCCPDTCGIKCLDPVDTPNPTRRKPGKCPVTYGQCLMLNPPNFCEMDGQCKRDLKCCMGMCGKSCVSPVKA

SEQ ID NO: 2816 - protein, 29 aa, Ovis aries
RGLRRLGRKIAHGVKKYGPTVLRIIRIAG

SEQ ID NO: 2817 - protein, 63 aa, Solanum tuberosum
GSSFCDSKCKLRCSKAGLADRCLKYCGICCEECKCVPSGTYGNKHECPCYRDKKNSKGKSKCP

SEQ ID NO: 2818 - protein, 66 aa, Solanum tuberosum
YSYKKIDCGGACAARCRLSSRPRLCNRACGTCCARCNCVPPGTSGNTETCPCYASLTTHGNKRKCP

SEQ ID NO: 2819 - protein, 25 aa, Artificial Sequence
  Description of Artificial Sequence: Synthetic anti-microbial peptide
HVDKKVADKVLLLKQLRIMRLLTRL

SEQ ID NO: 2820 - protein, 43 aa, Pan troglodytes
DLLPPRTPPYQVHISHQEARGPSFKICVGFLGPRWARGCSTGN

SEQ ID NO: 2821 - protein, 32 aa, Pan troglodytes
VHISHQEARGPSFKICVGFLGPRWARGCSTGN

SEQ ID NO: 2822 - protein, 53 aa, Pan troglodytes
DLLPPRTPPYQEPASDLKVVDFRRSEGFCQEYCNYMETQVGYCPKKKDACCLH

SEQ ID NO: 2823 - protein, 62 aa, Pan troglodytes
GDVPLGIRNTICRMQQGICRLFFCHSGEKKRDICSDPWNRCCVSNTDEEGKEKPEMDGRSGI

SEQ ID NO: 2824 - protein, 34 aa, Rattus norvegicus
QIVNCKKNEGFCQKYCNFMETQVGYCSKKKEACC

SEQ ID NO: 2825 - protein, 35 aa, Canis familiaris
  Canis lupus familiaris
RDVICLTQHGTCRLFFCHFGERKAEICSDPWNRCC

SEQ ID NO: 2826 - protein, 38 aa, Aptenodytes patagonicus
SFGLCRLRRGFCAHGRCRFPSIPIGRCSRFVQCCRRVW

SEQ ID NO: 2827 - protein, 38 aa, Aptenodytes patagonicus
SFGLCRLRRGFCARGRCRFPSIPIGRCSRFVQCCRRVW

SEQ ID NO: 2828 - protein, 40 aa, Spodoptera littoralis
VHVGPCDQVCSRIDPEKDECCRAHGYRGHSSCYYGRMECY

SEQ ID NO: 2829 - protein, 83 aa, Strongylocentrotus purpuratus
MDLRSASLVFLVVVMVLSYSMAAPLDADNDEEMEEIFNSIYHRKCVVKNRCETVSGHKTCKDLTCCRAVIFRHERPEVCRPST

SEQ ID NO: 2830 - protein, 87 aa, Strongylocentrotus purpuratus
MDLRSASLVFLVVAMVLSYSMAESFEVDDAVMEELWNPFRKLYRKECNDVTSCDTVSGVKTCTKKNCCHRKFFGKTILKAPECTVIS

SEQ ID NO: 2831 - protein, 18 aa, Artificial Sequence
  Description of Artificial Sequence: Synthetic anti-microbial peptide
KNLRRITRKIIHIIKKYG

SEQ ID NO: 2832 - protein, 44 aa, Tachypleus tridentatus
YSRCQLQGFNCVVRSYGLPTIPCCRGLTCRSYFPGSTYGRCQRF

SEQ ID NO: 2833 - protein, 44 aa, Tachypleus tridentatus
YSRCQLQGFNCVVRSYGLPTIPCCRGLTCRSYFPGSTYGRCQRY

SEQ ID NO: 2834 - protein, 42 aa, Tachypleus tridentatus
YVSCLFRGARCRVYSGRSCCFGYYCRRDFPGSIFGTCSRRNF

SEQ ID NO: 2835 - protein, 41 aa, Tachypleus tridentatus
DYDWSLRGPPKCATYGQKCRTWSPPNCCWNLRCKAFRCRPR

SEQ ID NO: 2836 - protein, 13 aa, Rana clamitans
FLPFLASLLSKVL

SEQ ID NO: 2837 - protein, 17 aa, Rana chensinensis
FVDLKKIANIINSIFGK

SEQ ID NO: 2838 - protein, 13 aa, Pelophylax saharica
FLSGIVGMLGKLF

SEQ ID NO: 2839 - protein, 13 aa, Pelophylax saharica
FLPIVTNLLSGLL

SEQ ID NO: 2840 - protein, 13 aa, Pelophylax saharica
FLSHIAGFLSNLF

SEQ ID NO: 2841 - protein, 21 aa, Rana sakuraii
AVDLAKIANIANKVLSSLFGK

SEQ ID NO: 2842 - protein, 13 aa, Rana tagoi
FLPILGKLLSGIL

SEQ ID NO: 2843 - protein, 13 aa, Rana versabilis
FLPLVGKILSGLI

SEQ ID NO: 2844 - protein, 13 aa, Rana temporaria
LLPIVGNLLKSLL

SEQ ID NO: 2845 - protein, 78 aa, Tenebrio molitor
DHHDGHLGGHQTGHQGGQQGGHLGGQQGGHLGGHQGGQPGGHLGGHQGGIGGTGGQQHGQHGPGTGAGHQGGYKTHGH

SEQ ID NO: 2846 - protein, 36 aa, Pseudacanthotermes spiniger
ACNFQSCWATCQAQHSIYFRRAFCDRSQCKCVFVRG

SEQ ID NO: 2847 - protein, 15 aa, Castanopsis chinensis
AKITFTNNHPRTIWP

SEQ ID NO: 2848 - protein, 30 aa, Phaseolus vulgaris
ANFEIVNNCPYTVWAAASPGGGRRLDRGQT

SEQ ID NO: 2849 - protein, 201 aa, Actinidia deliciosa
ATFNIINNCPFTVWAAAVPGGGKRLDRGQNWIINPGAGTKGARVWPRTGCNFDGAGRGKCQTGDCNGLLQCQAFGQPPNTLAEYALNQFNNLDFFDISLVDGFNVAMEFSPTSGGCTRGIKCTADINGQCPNELRAPGGCNNPCTVFKTDQYCCNSGNCGLTNFSKFFKDRCPDAYSYPKDDQTSTFTCPAGTNYKVVFCP

SEQ ID NO: 2850 - protein, 17 aa, Cassia didymobotrya
ATITFTNKCTRTVWPGG

SEQ ID NO: 2851 - protein, 20 aa, Actinidia chinensis
ATFNFINNCPFTVWAAAVPG

SEQ ID NO: 2852 - protein, 221 aa, Castanea sativa
AKITFTNNCPRTIWPGTLTSDQKPQLPNTGFVLASKASLTLGVQAPWKGRFWARTRCTTNSGKFTCETADCSTGQVACNGNGAIPPASLVEINIAANRGMDFYDVSLVDGYNLPVSVATRGGTGDCKATSCRANVNAVCPAELQVKGSDASVLACKSACTAFNQPQYCCTGAFDTARTCPATKYSRIFKQQCPQAYSYAYDDSTSTFTCSGAPDYVITFCP

SEQ ID NO: 2853 - protein, 76 aa, Aplysia californica
MDKKAANGGKEKGPLEACWDEWSRCTGWSSAGTGVLWKSCDDQCKKLGKSGGECVLTPSTCPFTRTDKAYQCQCKK

SEQ ID NO: 2854 - protein, 11 aa, Hoplobatrachus tigerinus
FCTMIPIPRCY

SEQ ID NO: 2855 - protein, 12 aa, Hoplobatrachus tigerinus
RVCFAIPLPICH

SEQ ID NO: 2856 - protein, 12 aa, Hoplobatrachus tigerinus
RVCYAIPLPICY

SEQ ID NO: 2857 - protein, 11 aa, Hoplobatrachus tigerinus
RVCYAIPLPIC

SEQ ID NO: 2858 - protein, 36 aa, Papio anubis; identical to SEQ ID NO: 442

SEQ ID NO: 2859 - protein, 40 aa, Papio anubis
IRNPVTCIRSGAICYPRSCPGSYKQIGVCGVSVIKCCKKP

SEQ ID NO: 2860 - protein, 35 aa, Sus scrofans
RDVICLMQHGTCRLFFCHSGEKKSEICSDPWNRCC

SEQ ID NO: 2861 - protein, 36 aa, Bubalus bubalis
NPVSCVRNKAICVPIRSPANMKQIGSCVGRAVKCCR

SEQ ID NO: 2862 - protein, 36 aa, Bos taurus
NPVSCVRNKGICVPIRCPGNMKQIGTCVGRAVKCCR

SEQ ID NO: 2863 - protein, 38 aa, Bos taurus
NPVSCVRNKGICVPIRCPGSMKQIGTCVGRAVKCCRKK

SEQ ID NO: 2864 - protein, 19 aa, Trichoderma longibrachiatum
AGFAAQAAASLAPVAAQQL

SEQ ID NO: 2865 - protein, 19 aa, Trichoderma longibrachiatum
AGFAAQAAASLAPVAIQQL

SEQ ID NO: 2866 - protein, 259 aa, Burkholderia dolosa
  AUO158
MNNLHRELAPIASAAWEQIEEEVARTFKRSVAGRRVVDVEGPKGPALSAVGTGHLRDVDAPREQVSARLREVRAIVELTVPFELSRDAIDSVERGARDADWQPAKDAAQRLAFAEDHAIFDGYAAAGIIGIREGSSNRRLTLPDDVGAYPDAISDALEALRLAGVDGPYSVLLGADAYTALSEARDQGYPVIDHIKRIVSGEIIWAPAISGGCVLSTRGGDYELHLGEDVSIGYTSHTDKVVRLYLRETFTFLMLTSEA

SEQ ID NO: 2867 - protein, 259 aa, Burkholderia cenocepacia; identical to SEQ ID NO: 906
  PC184

SEQ ID NO: 2868 - protein, 84 aa, Oryza sativa
MAGGRGRGGGGGGGVAGGGNLRPWECSPKCAGRCSNTQYKKACLTFCNKCCAKCLCVPPGTYGNKGACPCYNNWKTKEGGPKCP

SEQ ID NO: 2869 - protein, 129 aa, Zea mays
MASRNKAAALLLCFLFLAAVAASAAEMIAGSGIGDGEGEELDKGGGGGGGHHKHEGYKNKDGKGNLKPSQCGGECRRRCSKTHHKKPCLFFCNKCCAKCLCVPPGTYGNKETCPCYNNWKTKKGGPKCP

SEQ ID NO: 2870 - protein, 145 aa, Zea mays; identical to SEQ ID NO: 2252

SEQ ID NO: 2871 - protein, 41 aa, Artificial Sequence
  Description of Artificial Sequence: Synthetic anti-microbial polypeptide
SLDKRACNFQSCWATCQAQHSIYFRRAFCDRSQCKCVFVRG

SEQ ID NO: 2872 - protein, 29 aa, Unknown
  Description of Unknown: Anti-microbial peptide
KLAKLAKKLAKLAKGKRKKKGKLGKKRDP

SEQ ID NO: 2873 - protein, 26 aa, Unknown
  Description of Unknown: Anti-microbial peptide
KLAKLAKKLAKLAKKHLKKHLKKHLK

SEQ ID NO: 2874 - protein, 21 aa, Unknown
  Description of Unknown: Anti-microbial peptide
VKRGLKLKLAKLAKKLAKLAK

SEQ ID NO: 2875 - protein, 96 aa, Glycine max; identical to SEQ ID NO: 2452

SEQ ID NO: 2876 - protein, 115 aa, Glycine max
MALRELLMMGILLLVCLAKVSSDVNMQKEEDEELRFPNHPLIVRDGNRRLMQDIDCGGLCKTRCSAHSRPNVCNRACGTCCVRCKCVPPGTSGNRELCGTCYTDMITHGNKTKCP

SEQ ID NO: 2877 - protein, 90 aa, Glycine max; identical to SEQ ID NO: 2415

SEQ ID NO: 2878 - protein, 88 aa, Glycine max; identical to SEQ ID NO: 2383

SEQ ID NO: 2879 - protein, 88 aa, Glycine max; identical to SEQ ID NO: 2375

SEQ ID NO: 2880 - protein, 123 aa, Glycine max
MLLLLVENHAEIVVSTVEASAPQPHKNTTHTLSHAPAPQPHKNTKSPVPNLQHGITEGSLKPQECGPRCTARCSNTQYKKPCLFFCQKCCAKCLCVPPGTYGNKQVCPCYNNWKTKRGGPKCP

SEQ ID NO: 2881 - protein, 19 aa, Uperoleia mjobergii
GIIDIAKKLVGGIRNVLGI

SEQ ID NO: 2882 - protein, 29 aa, Viola arvensis
GLPVCGETCVGGTCNTPGCSCSWPVCTRN

SEQ ID NO: 2883 - protein, 29 aa, Viola arvensis
GLPICGETCVGGTCNTPGCSCSWPVCTRN

SEQ ID NO: 2884 - protein, 29 aa, Viola arvensis
GVPICGETCTLGTCYTAGCSCSWPVCTRN

SEQ ID NO: 2885 - protein, 76 aa, Bos taurus
LPVNSPMNKGDTEVMKCIVEVISDTLSKPSPMPVSKECFETLRGDERILSILRHQNLLKELQDLALQGAKERTHQQ

SEQ ID NO: 2886 - protein, 13 aa, Vespa magnifica
FLPIIAKLLGGLL

SEQ ID NO: 2887 - protein, 13 aa, Vespa magnifica
FLPIPRPILLGLL

SEQ ID NO: 2888 - protein, 13 aa, Vespa magnifica
FLIIRRPIVLGLL

SEQ ID NO: 2889 - protein, 13 aa, Vespa magnifica
FLPIIGKLLSGLL

SEQ ID NO: 2890 - protein, 68 aa, Macadamia integrifolia
RQRDPQQQYEQCQKHCQRRETEPRHMQTCQQRCERRYEKEKRKQQKRYEEQQREDEEKYEERMKEEDN

SEQ ID NO: 2891 - protein, 49 aa, Macadamia integrifolia
ESEFDRQEYEECKRQCMQLETSGQMRRCVSQCDKRFEEDIDWSKYDNQD

SEQ ID NO: 2892 - protein, 35 aa, Macadamia integrifolia
QCMQLETSGQMRRCVSQCDKRFEEDIDWSKYDNQE

SEQ ID NO: 2893 - protein, 41 aa, Macadamia integrifolia
DPQTDCQQCQRRCRQQESGPRQQQYCQRRCKEICEEEEEYN

SEQ ID NO: 2894 - protein, 41 aa, Macadamia integrifolia
DPQTECQQCQRRCRQQESDPRQQQYCQRRCKEICEEEEEYN

SEQ ID NO: 2895 - protein, 45 aa, Macadamia integrifolia
RQRDPQQQYEQCQERCQRHETEPRHMQTCQQRCERRYEKEKRKQQ

SEQ ID NO: 2896 - protein, 45 aa, Macadamia integrifolia
RQRDPQQQYEQCQKRCQRRETEPRHMQICQQRCERRYEKEKRKQQ

SEQ ID NO: 2897 - protein, 47 aa, Macadamia integrifolia
RQRDPQQQYEQCQERCQRHETEPRHMQTCQQRCERRYEKEKRKQQKR

SEQ ID NO: 2898 - protein, 47 aa, Macadamia integrifolia
RQRDPQQQYEQCQKRCQRRETEPRHMQICQQRCERRYEKEKRKQQKR

SEQ ID NO: 2899 - protein, 67 aa, Macadamia integrifolia
RQRDPQQQYEQCQERCQRHETEPRHMQTCQQRCERRYEKEKRKQQKRYEEQQREDEEKYEERMKEED

SEQ ID NO: 2900 - protein, 67 aa, Macadamia integrifolia
RQRDPQQQYEQCQKRCQRRETEPRHMQICQQRCERRYEKEKRKQQKRYEEQQREDEEKYEERMKEGD

SEQ ID NO: 2901 - protein, 35 aa, Macadamia integrifolia
KRDPQQREYEDCRRHCEQQEPRLQYQCQRRCQEQQ

SEQ ID NO: 2902 - protein, 35 aa, Macadamia integrifolia
KRDPQQREYEDCRRRCEQQEPRQQYQCQRRCREQQ

SEQ ID NO: 2903 - protein, 44 aa, Triticum kiharae
AQRCGDQARGAKCPNCLCCGKYGFCGSGDAYCGAGSCQSQCRGC

SEQ ID NO: 2904 - protein, 24 aa, Pseudopleuronectes americanus
GKGRWLERIGKAGGIIIGGALDHL

SEQ ID NO: 2905 - protein, 20 aa, Pseudopleuronectes americanus
WLRRIGKGVKIIGGAALDHL

SEQ ID NO: 2906 - protein, 26 aa, Pseudopleuronectes americanus
GRRKRKWLRRIGKGVKIIGGAALDHL

SEQ ID NO: 2907 - protein, 24 aa, Pseudopleuronectes americanus
FLGALIKGAIHGGRFIHGMIQNHH

SEQ ID NO: 2908 - protein, 25 aa, Pseudopleuronectes americanus
GWGSIFKHGRHAAKHIGHAAVNHYL

SEQ ID NO: 2909 - protein, 19 aa, Pseudopleuronectes americanus
FFRLLFHGVHHGGGYLNAA

SEQ ID NO: 2910 - protein, 19 aa, Pseudopleuronectes americanus
FFRLLFHGVHHVGKIKPRA

SEQ ID NO: 2911 - protein, 19 aa, Glyptocephalus cynoglossus
GWKKWLRKGAKHLGQAAIK

SEQ ID NO: 2912 - protein, 21 aa, Glyptocephalus cynoglossus
GFWGKLFKLGLHGIGLLHLHL

SEQ ID NO: 2913 - protein, 26 aa, Glyptocephalus cynoglossus
AGWGSIFKHIFKAGKFIHGAIQAHND

SEQ ID NO: 2914 - protein, 25 aa, Xenopus laevis
GWASKIGQTLGKIAKVGLKELIQPK

SEQ ID NO: 2915 - protein, 207 aa, Zea mays
AAVFTVVNQCPFTVWAASVPVGGGRQLNRGESWRITAPAGTTAARIWARTGCKFDASGRGSCRTGDCGGVLQCTGYGRAPNTLAEYALKQFNNLDFFDISLIDGFNVPMSFLPDGGSGCSRGPRCAVDVNARCPAELRQDGVCNNACPVFKKDEYCCVGSAANDCHPTNYSRYFKGQCPDAYSYPKDDATSTFTCPAGTNYKVVFCP

What is claimed is:

1. A pharmaceutical composition comprising:
a lipid-based nanoparticle comprising a synthetic messenger ribonucleic acid (mRNA) encoding a defensin polypeptide in an amount effective to permit production of the defensin polypeptide in a cell, wherein the synthetic mRNA comprises a translatable region that contains at least one nucleoside modification, and wherein 75-100% of uridine nucleotides in the synthetic mRNA are modified.

2. The pharmaceutical composition of claim 1, wherein the at least one nucleoside modification is selected from the group consisting of pyridin-4-one ribonucleoside, 5-aza-uridine, 2-thio-5-aza-uridine, 2-thiouridine, 4-thio-pseudouridine, 2-thio-pseudouridine, 5-hydroxyuridine, 3-methyluridine, 5-carboxymethyl-uridine, 1-carboxymethyl-pseudouridine, 5-propynyl-uridine, 1-propynylpseudouridine, 5-taurinomethyluridine, 1-taurinomethyl-pseudouridine, 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-1-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxyuridine, 2-methoxy-4-thio-uridine, 4-methoxy-pseudouridine, 4-methoxy-2-thio-pseudouridine, 5-aza-cytidine, pseudoisocytidine, 3-methyl-cytidine, N4-acetylcytidine, 5-formylcytidine, N4-methylcytidine, 5-hydroxymethylcytidine, 1-methyl-pseudoisocytidine, pyrrolo-cytidine, pyrrolo-pseudoisocytidine, 2-thio-cytidine, 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, 4-methoxy-1-methyl-pseudoisocytidine, 2-aminopurine, 2, 6-diaminopurine, 7-deaza-adenine, 7-deaza-8-aza-adenine, 7-deaza-2-aminopurine, 7-deaza-8-aza-2-aminopurine, 7-deaza-2,6-diaminopurine, 7-deaza-8-aza-2,6-diaminopurine, 1-methyladenosine, N6-methyladenosine, N6-isopentenyladenosine, N6-(cis-hydroxyisopentenyl)adenosine, 2-methylthio-N6-(cis-hydroxyisopentenyl) adenosine, N6-glycinylcarbamoyladenosine, N6-threonylcarbamoyladenosine, 2-methylthio-N6-threonyl carbamoyladenosine, N6,N6-dimethyladenosine, 7-methyladenine, 2-methylthio-adenine, 2-methoxy-adenine, inosine, 1-methyl-inosine, wyosine, wybutosine, 7-deaza-guanosine, 7-deaza-8-aza-guanosine, 6-thio-guanosine, 6-thio-7-deaza-guanosine, 6-thio-7-deaza-8-aza-guanosine, 7-methyl-guanosine, 6-thio-7-methyl-guanosine, 7-methylinosine, 6-methoxy-guanosine, 1-methylguanosine, N2-methylguanosine, N2,N2-dimethylguanosine, 8-oxo-guanosine, 7-methyl-8-oxo-guanosine, 1-methyl-6-thio-guanosine, N2-methyl-6-thio-guanosine, and N2,N2-dimethyl-6-thio-guanosine.

3. The pharmaceutical composition of claim 1, wherein the composition is formulated for administration via a route selected from the group consisting of: systemic, local, intravenous, topical, oral, administration via a dressing, administration via a bandage, rectal, vaginal, intramuscular, transarterial, intraperitoneal, intranasal, subcutaneous, endoscopic, transdermal and intrathecal.

4. The pharmaceutical composition of claim 3, wherein the route is intravenous.

5. The pharmaceutical composition of claim 1, wherein the defensin polypeptide is selected from the group consisting of α-defensins, and β-defensins and θ-defensins.

6. The pharmaceutical composition of claim 1, wherein the anti-microbial polypeptide is hBD-2 (SEQ ID NO: 191 or 192).

7. A kit comprising:
(a) a synthetic messenger ribonucleic acid (mRNA) encoding a defensin polypeptide packaged in a container, wherein the synthetic mRNA comprises a translatable region that contains at least one nucleoside modification, and wherein 75-100% of uridine nucleotides in the synthetic mRNA are modified; and
(b) a pharmaceutically acceptable carrier packaged in a container.

8. The pharmaceutical composition of claim 5, wherein the defensin is an α-defensin selected from the group consisting of neutrophil defensin 1, defensin alpha 1, neutrophil defensin 3, neutrophil defensin 4, defensin 5 and defensin 6.

9. The pharmaceutical composition of claim 5, wherein the defensin is a β-defensin selected from the group consisting of beta-defensin 1, beta-defensin 2, beta-defensin 103, beta-defensin 107, beta-defensin 110 and beta-defensin 136.

10. The pharmaceutical composition of claim 5, wherein the at least one nucleoside modification is pseudouridine.

11. The pharmaceutical composition of claim 5, wherein 100% of uridine nucleotides in the synthetic mRNA are modified.

12. The pharmaceutical composition of claim 5, wherein the synthetic mRNA further comprises a 5' untranslated region that contains at least one nucleoside modification.

13. The pharmaceutical composition of claim 5, wherein the synthetic mRNA further comprises a 5' untranslated region that contains at least two nucleoside modifications.

14. The pharmaceutical composition of claim 5, wherein the synthetic mRNA further comprises a 3' untranslated region that contains at least one nucleoside modification.

15. The pharmaceutical composition of claim 5, wherein the synthetic mRNA further comprises a 3' untranslated region that contains at least two nucleoside modifications.

16. A lipid-based nanoparticle comprising a synthetic messenger ribonucleic acid (mRNA) encoding a defensin polypeptide in an amount effective to permit production of the defensin polypeptide in a cell,
wherein 75-100% of uridine nucleotides in the synthetic mRNA are modified, and
wherein the synthetic mRNA comprises a translatable region, a 5' untranslated region and a 3' untranslated region, each of which contains at least one nucleoside modification.

17. The lipid-based nanoparticle of claim 16, wherein the at least one nucleoside modification is pseudouridine.

* * * * *